(12) United States Patent
Padigaru

(10) Patent No.: US 6,903,201 B2
(45) Date of Patent: Jun. 7, 2005

(54) PROTEINS AND NUCLEIC ACIDS ENCODING SAME

(75) Inventor: Muralidhara Padigaru, Branford, CT (US)

(73) Assignee: CuraGen Corporation, New Haven, CT (US)

(*) Notice: Subject to any disclaimer, the term of this patent is extended or adjusted under 35 U.S.C. 154(b) by 0 days.

(21) Appl. No.: 10/037,417

(22) Filed: Jan. 4, 2002

(65) Prior Publication Data

US 2004/0052806 A1 Mar. 18, 2004

Related U.S. Application Data

(60) Provisional application No. 60/318,700, filed on Sep. 12, 2001, provisional application No. 60/318,405, filed on Sep. 10, 2001, provisional application No. 60/305,060, filed on Jul. 12, 2001, provisional application No. 60/303,231, filed on Jul. 5, 2001, provisional application No. 60/272,817, filed on Mar. 2, 2001, provisional application No. 60/272,411, filed on Jul. 28, 2001, provisional application No. 60/260,360, filed on Jan. 8, 2001, and provisional application No. 60/260,018, filed on Jan. 5, 2001.

(51) Int. Cl.$^7$ .............................................. C12N 15/12
(52) U.S. Cl. ................................... 536/23.5; 536/23.1
(58) Field of Search ............................ 536/23.1, 23.5; 435/6, 320.1, 252.3, 325; 514/44

(56) References Cited

FOREIGN PATENT DOCUMENTS

| DE | 100 31 932 | 10/2002 |
|---|---|---|
| WO | WO 99/47540 | 9/1999 |
| WO | WO 00/55173 | 9/2000 |
| WO | WO 01/77155 | 10/2001 |
| WO | WO 01/83516 | 11/2001 |
| WO | WO 01/83782 | 11/2001 |
| WO | WO 01/98342 | 12/2001 |

OTHER PUBLICATIONS

Sottrup–Jensen et al, Proc. Natl. Acad. Sci. USA 81: 7353 (1984).*
Dear, T. N., N. T. Meier, et al. (2000). "Gene structure, chromosomal localization, and expression pattern of Capn 12, a new member of the calpain large subunit gene family." Genomics 68(2): 152–60.
Klein, R. D., Q. Gu, et al. (1996). "Selection for genes encoding secreted proteins and receptors." Proc Natl Acad Sci U S A 93(14): 7108–13.
Tremblay, L. O. and A. Herscovics (1999). "Cloning and expression of a specific human alpha 1,2–mannosidase that trims Man9GlcNAc2 to Man8GlcNAc2 Isomer B during N–glycan biosynthesis." Glycobiology 9(10): 1073–8.
International Search Report of PCT/US01/50925 mailed Sep. 4, 2003.
Chernova, O. B., R. P. Somerville, et al. (1998). "A novel gene. LG11, from 10q24 is rearranged and downregulated in malignant brain tumors." Oncogene 17(22): 2873–81.

De Vivo, I., X. Cui, et al. (1998). "Growth stimulation of primary B cell precursors by the anti–phosphatase Sbf1." Proc Natl Acad Sci U S A 95(16):9471–6.
Durkin, M. E., F. Loechel, et al. (1997). "Tissue–specific expression of the human laminin alpha5–chain, and mapping of the gene to human chromosome 20q13.2–13.3 and to distal mouse chromosome 2 near the locus for the ragged (Ra) mutation." FEBS Lett 411(2–3): 296–300.
Miner, J. H., et al., (1995) "Molecular cloning of a novel laminin chain, alpha–5, and widespread expression in adult mouse tissues." The Journal of Biological Chemistry 270 (48): 28523–26.
Nagase, T., K, Ishikawa, et al. (1998). "Prediction of the coding sequences of unidentified human genes. IX. The complete sequences of 100 new cDNA clones from brain which can code for large proteins in vitro." DNA Res 5(1):31–9.
Pierce, R. A., G. L. Griffin, et al. (2000). "Expression patterns of laminin alpha1 and alpha5 in human lung during development." Am J Respir Cell Mol Biol 23(6): 742–7.
Seebacher, T., J. L. Medina, et al. (1997), "Laminin alpha 5, a major transcript of normal and malignant rat liver epithelial cells, is differentially expressed in developing and adult liver." Exp Cell Res 237(1): 70–6.
Yu, J. X., L. Chao, et al. (1995). "Molecular cloning, tissue–specific expression, and cellular localization of human prostasin mRNA." J Biol Chem 270(22): 13483–9.
International Search Report of PCT/US/02/00375 mailed Aug. 28, 2003.
Abts et al. (1999). "Cloning and characterization of hurpin (protease inhibitor 13): A new skin–specific, UV–repressible serine proteinase inhibitor of the ovalbumin serpin family," *J Mol Biol* 293(1): 29–39.
Alderborn et al. (2000). "Determination of single–nucleotide polymorphisms by real–time pyrophosphate DNA sequencing." *Genome Res* 10(8): 1249–1258.
Bouillaud et al. (1985). "Molecular approach to thermogenesis in brown adipose tissue: cDNA cloning of the mitochondrial uncoupling protein." *Proc Natl Acad Sci U S A* 82(2): 445–448.
Bouillaud et al. (1988). "Detection of brown adipose tissue uncoupling protein mRNA in adult patients by a human genomic probe." *Clin Sci* (Lond) 75(1): 21–27.

(Continued)

*Primary Examiner*—James Martinell
(74) *Attorney, Agent, or Firm*—Ivor R. Elrifi; Naomi S. Biswas; Mintz Levin Cohn Ferris Glovsky & Popeo, PC

(57) ABSTRACT

Disclosed herein are nucleic acid sequences that encode novel polypeptides. Also disclosed are polypeptides encoded by these nucleic acid sequences, and antibodies, which immunospecifically-bind to the polypeptide, as well as derivatives, variants, mutants, or fragments of the aforementioned polypeptide, polynucleotide, or antibody. The invention further discloses therapeutic, diagnostic and research methods for diagnosis, treatment, and prevention of disorders involving any one of these novel human nucleic acids and proteins.

6 Claims, No Drawings

OTHER PUBLICATIONS

Braisted et al. (2000). "Netrin–1 promotes thalamic axon growth and is required for proper development of the thalamocortical projection." *J Neurosci* 20(15): 5792–5801.

Cassard et al. (1990). "Human uncoupling protein gene: structure, comparison with rat gene, and assignment to the long arm of chromosome 4." *J Cell Biochem* 43(3): 255–264.

Cui et al. (1998), "Association of SET domain and myotubularin–related proteins modulates growth control." *Nat Genet* 18(4): 331–337.

Delhanty and Baxter (1996). "The cloning and expression of the baboon acid–labile subunit of the insulin–like growth factor binding protein complex." *Biochem Biophys Res Commun* 227(3): 897–902.

Echtay et al. (2000). "Coenzyme Q is an obligatory cofactor for uncoupling protein function." *Nature* 408(6812):609–613.

Ellezam et al. (2001). "Expression of netrin–1 and its receptors DCC and UNC–5H2 after axolomy and during regeneration of adult rat retinal ganglion cells." *Exp Neurol* 168(1): 105–115.

Elliott et al. (1986). "Assignment of pancreatic ribonuclease gene to mouse chromosome 14." *Cytogenet Cell Genet* 42(1–2): 110–112.

Enerback et al. (1997). "Mice lacking mitochondrial uncoupling protein are cold–sensitive but not obese." *Nature* 387(6628): 90–94.

Firestein and Clearly (2001). "Pseudo–phosphalase Sbf1 contains an N–terminal GEF homology domain that modulates its growth regulatory properties," *J Cell Sci* 114(Pt 16): 2921–2927.

Firestein et al. (2000). "Set domain–dependent regulation of transcriptional silencing and growth control by SUV39H1, a mammalian ortholog of Drosophila Su(var)3–9," *Mol Cell Biol* 20(13): 4900–4909.

Fletcher et al. (1991). "A multilocus linkage map of mouse chromosome 8." *Genomics* 9(4): 737–741.

GenBank Accession No.: A32446 (Feb. 18, 2000).
GenBank Accession No.: AAB41297 (Jan. 24, 1997).
GenBank Accession No.: AAB46848 (Feb. 11, 1997).
GenBank Accession No.: AAC39675 (Apr. 3, 1998).
GenBank Accession No.: AAC67491 (Oct. 24, 1998).
GenBank Accession No.: AAD26567 (Apr. 21, 1999).
GenBank Accession No.: AAD46477 (Aug. 2, 1999).
GenBank Accession No.: AAF07072 (Nov. 10, 1999).
GenBank Accession No.: AAF08787 (Nov. 18 1999).
GenBank Accession No.: AAF19031 (Dec. 20, 1999).
GenBank Accession No.: AAG32641 (Nov. 16, 2000).
GenBank Accession No. AAH03448 (Jul. 12, 2001).
GenBank Accession No.: AAK93570 (Aug. 27, 2001).
GenBank Accession No.: AB011105 (Apr. 10, 1998).
GenBank Accession No.: AB018694 (Oct. 5, 1999).
GenBank Accession No.: AB030036 (Jan. 6, 2001).
GenBank Accession No.: AB051553 (Feb. 7, 2001).
GenBank Accession No.: AB067503 (Sep. 15, 2001).
GenBank Accession No.: AF055634 (Oct. 24, 1998).
GenBank Accession No.: AF059507 (Apr. 25, 1998).
GenBank Accession No.: AF065388 (Apr. 28, 2000).
GenBank Accession No.: AF072132 (Jan. 10, 2001).
GenBank Accession No.: AF113614 (Aug. 2, 1999).
GenBank Accession No.: AF126540 (Apr. 21, 1999).
GenBank Accession No.: AF163101 (Nov. 18, 1999).
GenBank Accession No.: AF169949 (Oct. 28, 1999).
GenBank Accession No.: AF202076 (Nov. 16, 2000).
GenBank Accession No.: AF206661 (Dec. 20, 1999).
GenBank Accession No.: AF216854 (Jul. 24, 2000).
GenBank Accession No.: AJ001696 (Oct. 8, 1999).
GenBank Accession No.: AJ001698 (Oct. 8, 1999).
GenBank Accession No.: AJ278717 (Apr. 21, 2001).
GenBank Accession No.: AL096767 (Jan. 11, 2000).
GenBank Accession No.: AL138538 (Feb. 1, 2000).
GenBank Accession No.: AL358154 (Sep. 20, 2001).
GenBank Accession No.: AY052146 (Aug. 27, 2001).
GenBank Accession No.: BAA84941 (Oct. 5, 1999).
GenBank Accession No.: BAB20376 (Jan. 6, 2001).
GenBank Accession No.: BAB21857 (Feb. 7, 2001).
GenBank Accession No.: BAB67809 (Sep. 15, 2001).
GenBank Accession No.: BC003448 (Jul. 12, 2001).
GenBank Accession No.: CAA04937 (Oct. 8, 1999).
GenBank Accession No.: CAB09137 (Jul. 24, 1997).
GenBank Accession No.: CAB63063 (Jan. 11, 2000).
GenBank Accession No.: CAC03569 (Apr. 21, 2001).
GenBank Accession No.: CAC78757 (Sep. 20, 2001).
GenBank Accession No.: JC5274 (Jun. 20, 2000).
GenBank Accession No.: JC7118 (May, 26, 2000).
GenBank Accession No.: L07288 (Oct. 19, 1993).
GenBank Accession No.: NM_001444 (Dec. 18, 2001).
GenBank Accession. No.: NM_002773 (Oct. 31, 2000).
GenBank Accession No.: NM_003728 (Dec. 20, 2001).
GenBank Accession No.: NM_005097 (Nov. 1, 2000).
GenBank Accession No.: NM_005727 (Nov. 1, 2000).
GenBank Accession No.: NM_007376 (Jan. 7, 2002).
GenBank Accession No.: NM_008148 (Jan. 7, 2002).
GenBank Accession No.: NM_008533 (Jan. 7, 2002).
GenBank Accession No.: NM_008645 (Jan. 7, 2002).
GenBank Accession No.: NM_009472 (Jan. 7, 2002).
GenBank Accession No.: NM_012397 (Nov. 4, 2000).
GenBank Accession No.: NM_020278 (Jan. 7, 2002).
GenBank Accession No.: NM_021833 (Mar. 9, 2001).
GenBank Accession No.: NM_022207 (Dec. 6, 2000).
GenBank Accession No.: NM_032559 (Aug. 8, 2001).
GenBank Accession No.: NM_057269 (Jan. 10, 2002).
GenBank Accession No.: NM_078044 (Dec. 3, 2001).
GenBank Accession No.: NP_001435 (Dec. 18, 2001).
GenBank Accession No.: NP_002764 (Oct. 31, 2000).
GenBank Accession No.: NP_003719 (Dec. 20, 2001).
GenBank Accession No.: NP_005088 (Nov. 1, 2000).
GenBank Accession No.: NP_005718 (Nov. 1, 2000).
GenBank Accession No.: NP_031402 (Jan. 7, 2002).
GenBank Accession No.: NP_032174 (Jan. 7, 2002).
GenBank Accession No.: NP_032671 (Jan. 7, 2002).
GenBank Accession No.: NP_033498 (Jan. 7, 2002).
GenBank Accession No.: NP_036529 (Nov. 4, 2000).
GenBank Accession No.: NP_064674 (Jan. 7, 2002).
GenBank Accession No.: NP_068605 (Mar. 9, 2001).
GenBank Accession No.: NP_071543 (Dec. 6, 2000).
GenBank Accession No.: NP_476617 (Jan. 10, 2002).
GenBank Accession No.: NP_510445 (Dec. 3, 2001).
GenBank Accession No.: O02833 (Oct. 16, 2001).
GenBank Accession No.: O15230 (Mar. 1, 2002).
GenBank Accession No.: O60635 (Aug. 20, 2001).
GenBank Accession No.: P00673 (May, 30 2000).
GenBank Accession No.: P02750 (Oct. 16, 2001).
GenBank Accession No.: P04575 (Oct. 16, 2001).
GenBank Accession No.: P14271 (Oct. 16, 2001).
GenBank Accession No.: P20740 (Nov. 1, 1995).
GenBank Accession No.: P20742 (Aug. 20, 2001).

GenBank Accession No.: P25874 (Aug. 20, 2001).
GenBank Accession No.: P29508 (Oct. 16, 2001).
GenBank Accession No.: P55052 (May, 30, 2000).
GenBank Accession No.: Q00174 (Mar. 1, 2002).
GenBank Accession No.: Q16651 (Mar. 1, 2002).
GenBank Accession No.: S83247 (Feb. 11, 1997).
GenBank Accession No.: T10053 (Jan. 11, 2000).
GenBank Accession No.: U28480 (Jan. 17, 1996).
GenBank Accession No.: U37501 (Nov. 10, 1997).
GenBank Accession No.: U53204 (Dec. 13, 2001).
GenBank Accession No.: U55188 (Jan. 25, 1997).
GenBank Accession No.: U87306 (May 15, 1997).
GenBank Accession No.: U91967 (Aug. 17, 1997).
GenBank Accession No.: U93181 (Apr. 3, 1998).
GenBank Accession No.: X54380 (Jan. 10, 1992).
GenBank Accession No.: X94982 (May 22, 1996).
GenBank Accession No.: XM_006924 (Feb. 7, 2002).
GenBank Accession No.: XM_011655 (Feb. 7, 2002).
GenBank Accession No.: XM_037217 (Feb. 7, 2002).
GenBank Accession No.: XM_037447 (Feb. 7, 2002).
GenBank Accession No.: XM_042940 (Feb. 6, 2002).
GenBank Accession No.: XM_058653 (Feb. 7, 2002).
GenBank Accession No.: XP_006924 (Feb. 7, 2002).
GenBank Accession No.: XP_011655 (Feb. 7, 2002).
GenBank Accession No.: XP_037217 (Feb. 7, 2002).
GenBank Accession No.: XP_037447 (Feb. 7, 2002).
GenBank Accession No.: XP_042940 (Feb. 6, 2002).
GenBank Accession No.: XP_058653 (Feb. 7, 2002).
GenBank Accession No.: Z70227 (Nov. 23, 1999).
GenBank Accession No.: Z95636 (Jul. 24, 1997).
Jacobson et al. (1985). "Cardiac sarcoplasmic reticulum. Effects of an atherogenic diet during the neonatal and juvenile period." *Atherosclerosis* 55(1): 81–91.
Lowell et al. (1993). "Development of obesity in transgenic mice after genetic ablation of brown adipose tissue." *Nature* 366(6457): 740–742.
Marynen et al. (1989), "Partial primary structure of the 48– and 90–kilodalton core proteins of cell surface–associated heparan sulfate proteoglycans of lung fibroblasts. Prediction of an integral membrane domain and evidence for multiple distinct core proteins at the cell surface of human lung fibroblasts." *J Biol Chem* 264(12): 7017–7024.
Mavroidis et al. (1995). "Isolation, primary structure, and evolution of the third component of chicken complement and evidence for a new member of the alpha 2– macroglobulin family." *J. Immunol* 154(5): 2164–2174.
Miyake et al. (1995). "RP105, a novel B cell surface molecule implicated in B cell activation, is a member of the leucine–rich repeat protein family," *J Immunol* 154(7): 3333–3340.
Nakagawa et al. (2001). "Schwann cell myelination occurred without basal lamina formation in laminin alpha2 chain–null mutant (dy3K/dy3K) mice." *Glia* 35(2): 101–110.

Piccoli et al. (1999). "A dimeric mutant of human pancreatic ribonuclease with selective cytotoxicity toward malignant cells." *Proc Natl Acad Sci U S A* 96(14): 7768–7773.
Pittenger et al. (1999). "Multilineage potential of adult human mesenchymal stem cells." *Science* 284(5411): 143–147.
Ridley et al. (1986). "Complete nucleotide and derived amino acid sequence of cDNA encoding the mitochondrial uncoupling protein of rat brown adipose tissue: lack of a mitochondrial targeting presequence." *Nucleic Acids Res* 14(10): 4025–4035.
Rothberg et al. (1990). "slit: an extracellular protein necessary for development of midline glia and commissural axon pathways contains both EGF and LRR domains" *Genes Dev* 4(12A): 2169–2187.
Son et al. (2000). "The synaptic vesicle protein SV2 is complexed with an alpha5–containing laminin on the nerve terminal surface." *J Biol Chem* 275(1): 451–460.
SWALL (SPTR) Accession No.: O08722 (Jul. 1, 1997).
SWALL (SPTR) Accession No.: O60228 (Aug. 1, 1998).
SWALL (SPTR) Accession No.: Q9ES87 (Oct. 16, 2001).
SWALL (SPTR) Accession No.: Q9J1A1 (Oct. 1, 2000).
SWALL (SPTR) Accession No.: Q9UGB8 (May 1, 2000).
SWALL (SPTR) Accession No.: Q9UIV8 (Oct. 16, 2001).
SWALL (SPTR) Accession No.: Q9UKG0 (Oct. 16, 2001).
Thomas and Palmiter (1997). "Thermoregulatory and metabolic phenotypes of mice lacking noradrenaline and adrenaline." *Nature* 387(6628): 94–97.
Unger and Orci (2000). "Lipotoxic diseases of nonadipose tissues in obesity." *Int J Obes* 24(Suppl 4): S28–S32.
Unger and Orci (2001). "Diseases of liporegulation: new perspective on obesity and related disorders." *Faseb J* 15(2): 312–321.
Wootton and Federhen (1996). "Analysis of compositionally biased regions in sequence databases." *Methods Enzymol* 266: 554–571.
Yu et al. (1995). "Relationship between serum prostate specific antigen concentration and prostate volume." *J Formos Med Assoc* 94(11): 666–670.
Yu et al. (1994). "Prostasin is a novel human serine proteinase from seminal fluid. Purification, tissue distribution, and localization in prostate gland." *J Biol Chem* 269(29): 18843–18848.
Yu and Toole (1996). "A new alternatively spliced exon between v9 and v10 provides a molecular basis for synthesis of soluble CD44." *J Biol Chem* 271(34): 20603–20607.

* cited by examiner

PROTEINS AND NUCLEIC ACIDS ENCODING SAME

RELATED APPLICATIONS

This application claims priority from U.S. Ser. No. 60/260,018, filed Jan. 5, 2001; U.S. Ser. No. 60/260,360, filed Jan. 8, 2001; U.S. Ser. No. 60/272,411 filed Feb. 28, 2001; U.S. Ser. No. 60/272,817 filed Mar. 2, 2001; U.S. Ser. No. 60/303,231, filed Jul. 5, 2001; U.S. Ser. No. 60/305,060 filed Jul. 12, 2001; U.S. Ser. No. 60/318,405, filed Sep. 10, 2001; U.S. Ser. No. and 60/318,700 filed Sep. 12, 2001; each of which is incorporated by reference in its entirety.

FIELD OF THE INVENTION

The invention generally relates to nucleic acids and polypeptides encoded thereby.

BACKGROUND OF THE INVENTION

The invention generally relates to nucleic acids and polypeptides encoded therefrom. More specifically, the invention relates to nucleic acids encoding cytoplasmic, nuclear, membrane bound, and secreted polypeptides, as well as vectors, host cells, antibodies, and recombinant methods for producing these nucleic acids and polypeptides.

SUMMARY OF THE INVENTION

The invention is based in part upon the discovery of nucleic acid sequences encoding novel polypeptides. The novel nucleic acids and polypeptides are referred to herein as NOVX, or NOV1, NOV2, NOV3, NOV4, NOV5, NOV6, NOV7, NOV8, NOV9, NOV10, NOV11, NOV12, NOV13, and NOV14 nucleic acids and polypeptides. These nucleic acids and polypeptides, as well as derivatives, homologs, analogs and fragments thereof, will hereinafter be collectively designated as "NOVX" nucleic acid or polypeptide sequences.

In one aspect, the invention provides an isolated NOVX nucleic acid molecule encoding a NOVX polypeptide that includes a nucleic acid sequence that has identity to the nucleic acids disclosed in SEQ ID NOS:1, 3, 5, 7, 9, 11, 13, 15, 17, 19, 21, 23, 25, 27, 29, 31, 33, 35, 37, 39, 41, 43, 45, and 197. In some embodiments, the NOVX nucleic acid molecule will hybridize under stringent conditions to a nucleic acid sequence complementary to a nucleic acid molecule that includes a protein-coding sequence of a NOVX nucleic acid sequence. The invention also includes an isolated nucleic acid that encodes a NOVX polypeptide, or a fragment, homolog, analog or derivative thereof. For example, the nucleic acid can encode a polypeptide at least 80% identical to a polypeptide comprising the amino acid sequences of SEQ ID NOS:2, 4, 6, 8, 10, 12, 14, 16, 18, 20, 22, 24, 26, 28, 30, 32, 34, 26, 28, 40, 42, 44, 46, and 198. The nucleic acid can be, for example, a genomic DNA fragment or a cDNA molecule that includes the nucleic acid sequence of any of SEQ ID NOS:1, 3, 5, 7, 9, 11, 13, 15, 17, 19, 21, 23, 25, 27, 29, 31, 33, 35, 37, 39, 41, 43, 45, and 197.

Also included in the invention is an oligonucleotide, e.g., an oligonucleotide which includes at least 6 contiguous nucleotides of a NOVX nucleic acid (e.g., SEQ ID NOS:1, 3, 5, 7, 9, 11, 13, 15, 17, 19, 21, 23, 25, 27, 29, 31, 33, 35, 37, 39, 41, 43, 45, and 197) or a complement of said oligonucleotide.

Also included in the invention are substantially purified NOVX polypeptides (SEQ ID NOS:2, 4, 6, 8, 10, 12, 14, 16, 18, 20, 22, 24, 26, 28, 30, 32, 34, 26, 28, 40, 42, 44, 46, and 198). In certain embodiments, the NOVX polypeptides include an amino acid sequence that is substantially identical to the amino acid sequence of a human NOVX polypeptide.

The invention also features antibodies that immunoselectively bind to NOVX polypeptides, or fragments, homologs, analogs or derivatives thereof.

In another aspect, the invention includes pharmaceutical compositions that include therapeutically- or prophylactically-effective amounts of a therapeutic and a pharmaceutically-acceptable carrier. The therapeutic can be, e.g., a NOVX nucleic acid, a NOVX polypeptide, or an antibody specific for a NOVX polypeptide. In a further aspect, the invention includes, in one or more containers, a therapeutically- or prophylactically-effective amount of this pharmaceutical composition.

In a further aspect, the invention includes a method of producing a polypeptide by culturing a cell that includes a NOVX nucleic acid, under conditions allowing for expression of the NOVX polypeptide encoded by the DNA. If desired, the NOVX polypeptide can then be recovered.

In another aspect, the invention includes a method of detecting the presence of a NOVX polypeptide in a sample. In the method, a sample is contacted with a compound that selectively binds to the polypeptide under conditions allowing for formation of a complex between the polypeptide and the compound. The complex is detected, if present, thereby identifying the NOVX polypeptide within the sample.

The invention also includes methods to identify specific cell or tissue types based on their expression of a NOVX.

Also included in the invention is a method of detecting the presence of a NOVX nucleic acid molecule in a sample by contacting the sample with a NOVX nucleic acid probe or primer, and detecting whether the nucleic acid probe or primer bound to a NOVX nucleic acid molecule in the sample.

In a further aspect, the invention provides a method for modulating the activity of a NOVX polypeptide by contacting a cell sample that includes the NOVX polypeptide with a compound that binds to the NOVX polypeptide in an amount sufficient to modulate the activity of said polypeptide. The compound can be, e.g., a small molecule, such as a nucleic acid, peptide, polypeptide, peptidomimetic, carbohydrate, lipid or other organic (carbon containing) or inorganic molecule, as further described herein.

Also within the scope of the invention is the use of a therapeutic in the manufacture of a medicament for treating or preventing disorders or syndromes including, e.g., Von Hippel-Lindau (VHL) syndrome, tuberous sclerosis, hypercalceimia, Lesch-Nyhan syndrome, multiple sclerosis, Corneal dystrophy, Thiel-Behake type; Dubin-Johnson syndrome; Retinol binding protein, deficiency of; SEMD, Split hand/foot malformation, type 3; Tolbutamide poor metabolizer; Urofacial syndrome; Warfarin sensitivity; Wolman disease, Combined factor V and VIII deficiency; Cone-rod retinal dystrophy-1; myasthenia gravis, endometriosis, pancreatitis, hyperparathyroidism, hypoparathyroidism, xerostomia, actinic keratosis, acne, hair growthloss, allopecia, pigmentation disorders, endocrine disorders, tonsillitis, cystitis, incontinence, fatty acid transport of skin, oral mucosa, uveitis and corneal fibroblast proliferation, amyotrophic lateral sclerosis, acute pancreatitis, cerebral cryptococcosis, colitis, thyroiditis, cirrhosis, Alzheimer's disease, stroke, Parkinson's disease, Huntington's disease, cerebral palsy, epilepsy, ataxia-telangiectasia, behavioral disorders, addiction, anxiety, pain, neurodegeneration; Pakistani type; Spinocerebellar ataxia, infantile-onset, with sensory neuropathy, neuroprotection, muscular dystrophy, leukodystrophies, Leukemia, T-cell acute lymphocytic; Colorectal cancer; Leukemia/lymphoma, B-cell, 2; Lymphoma/leukemia, Osteosarcoma; cancer, lymphedema, Cholesteryl ester storage disease; diabetes, obesity, fertility, growth and reproductive disorders, pregnancy, hypertensive toxemia, pre-eclampsia/eclampsia (gestational proteinuric hypertension), glomerular endotheliosis, cholestasis, and pruritic urticarial papules and plaques of pregnancy autoimmune disease, lupus erythematosus, tuberous sclerosis, scleroderma, B-cell, variant; Protoporphyria, erythropoietic; Protoporphyria, erythropoietic, recessive, with liver failure; skin psoriasis, allergic encephalomyelitis, various forms of arthritis, cancer such as AML, bacterial infections, graft versus host disease (GVHD), lymphaedema renal artery stenosis, interstitial nephritis, glomerulonephritis, polycystic kidney disease, systemic renal tubular acidosis, IgA nephropathy, asthma, emphysema, scleroderma, allergy, ARDS, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, transplantation, ulcers, and/or other pathologies and disorders of the like.

The therapeutic can be, e.g., a NOVX nucleic acid, a NOVX polypeptide, or a NOVX-specific antibody, or biologically-active derivatives or fragments thereof. For example, the compositions of the present invention will have efficacy for treatment of patients suffering from the diseases and disorders disclosed above and/or other pathologies and disorders of the like. The polypeptides can be used as immunogens to produce antibodies specific for the invention, and as vaccines. They can also be used to screen for potential agonist and antagonist compounds. For example, a cDNA encoding NOVX may be useful in gene therapy, and NOVX may be useful when administered to a subject in need thereof. By way of non-limiting example, the compositions of the present invention will have efficacy for treatment of patients suffering from the diseases and disorders disclosed above and/or other pathologies and disorders of the like.

The invention further includes a method for screening for a modulator of disorders or syndromes including, e.g., the diseases and disorders disclosed above and/or other pathologies and disorders of the like. The method includes contacting a test compound with a NOVX polypeptide and determining if the test compound binds to said NOVX polypeptide. Binding of the test compound to the NOVX polypeptide indicates the test compound is a modulator of activity, or of latency or predisposition to the aforementioned disorders or syndromes.

Also within the scope of the invention is a method for screening for a modulator of activity, or of latency or predisposition to disorders or syndromes including, e.g., the diseases and disorders disclosed above and/or other pathologies and disorders of the like by administering a test compound to a test animal at increased risk for the aforementioned disorders or syndromes. The test animal expresses a recombinant polypeptide encoded by a NOVX nucleic acid. Expression or activity of NOVX polypeptide is then measured in the test animal, as is expression or activity of the protein in a control animal which recombinantly-expresses NOVX polypeptide and is not at increased risk for the disorder or syndrome. Next, the expression of NOVX polypeptide in both the test animal and the control animal is compared. A change in the activity of NOVX polypeptide in the test animal relative to the control animal indicates the test compound is a modulator of latency of the disorder or syndrome.

In yet another aspect, the invention includes a method for determining the presence of or predisposition to a disease associated with altered levels of a NOVX polypeptide, a NOVX nucleic acid, or both, in a subject (e.g., a human subject). The method includes measuring the amount of the NOVX polypeptide in a test sample from the subject and comparing the amount of the polypeptide in the test sample to the amount of the NOVX polypeptide present in a control sample. An alteration in the level of the NOVX polypeptide in the test sample as compared to the control sample indicates the presence of or predisposition to a disease in the subject. Preferably, the predisposition includes, e.g., the diseases and disorders disclosed above and/or other pathologies and disorders of the like. Also, the expression levels of the new polypeptides of the invention can be used in a method to screen for various cancers as well as to determine the stage of cancers.

In a further aspect, the invention includes a method of treating or preventing a pathological condition associated with a disorder in a mammal by administering to the subject a NOVX polypeptide, a NOVX nucleic acid, or a NOVX-specific antibody to a subject (e.g., a human subject), in an amount sufficient to alleviate or prevent the pathological condition. In preferred embodiments, the disorder, includes, e.g., the diseases and disorders disclosed above and/or other pathologies and disorders of the like.

In yet another aspect, the invention can be used in a method to identity the cellular receptors and downstream effectors of the invention by any one of a number of techniques commonly employed in the art. These include but are not limited to the two-hybrid system, affinity purification, co-precipitation with antibodies or other specific-interacting molecules.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In the case of conflict, the present specification, including definitions, will control. In addition, the materials, methods; and examples are illustrative only and not intended to be limiting.

Other features and advantages of the invention will be apparent from the following detailed description and claims.

DETAILED DESCRIPTION OF THE INVENTION

The present invention provides novel nucleotides and polypeptides encoded thereby. Included in the invention are the novel nucleic acid sequences and their encoded polypeptides.

The sequences are collectively referred to herein as "NOVX nucleic acids" or "NOVX polynucleotides" and the corresponding encoded polypeptides are referred to as "NOVX polypeptides" or "NOVX proteins." Unless indicated otherwise, "NOVX" is meant to refer to any of the novel sequences disclosed herein. Table A provides a summary of the NOVX nucleic acids and their encoded polypeptides.

TABLE A

Sequences and Corresponding SEQ ID Numbers

| NOVX Assignment | Internal Identification | SEQ ID NO (nucleic acid) | SEQ ID NO (polypeptide) | Homology |
|---|---|---|---|---|
| 1a | CG55974-01 | 1 | 2 | Human laminin alpha 5-like |
| 1b | CG102167-01 | 3 | 4 | Human laminin alpha 5-like |
| 1c | CG55974-02 | 5 | 6 | Human laminin alpha 5-like |
| 1d | 164875783 | 7 | 8 | Human laminin alpha 5-like |
| 2a | CG55999-01 | 9 | 10 | Human Hurpin/PI 13-like |
| 2b | CG55999-02 | 11 | 12 | Human Hurpin/PI 13-like |
| 2c | CG55999-05 | 13 | 14 | Human Hurpin/PI 13-like |
| 2d | CG55999-06 | 15 | 16 | Human Hurpin/PI 13-like |
| 2e | 166485357 | 197 | 198 | Human Hurpin/PI 13-like |
| 3a | CG56019-01 | 17 | 18 | Set Binding Factor (SBF1) - like |
| 3b | CG56019-02 | 19 | 20 | Set Binding Factor (SBF1) - like |
| 4 | CG55692-01 | 21 | 22 | TSPAN-1-like |
| 5 | CG56073-01 | 23 | 24 | Fatty Acid-Binding Protein, Epidermal-like |
| 6 | CG50261-02 | 25 | 26 | Uncoupling Protein 1-like |
| 7a | CG56077-01 | 27 | 28 | Leucine-Rich Glioma-Inactivated Protein-like |
| 7b | CG56077-02 | 29 | 30 | Leucine-Rich Glioma-Inactivated Protein-like |
| 8 | AL163195_dal | 31 | 32 | RNase-like |
| 9 | CG56069-01 | 33 | 34 | Insulin like growth factor binding protein-like |
| 10 | SC133419534_A | 35 | 36 | Novel pregnancy zone protein precursor-like |
| 11 | SC139725617_A | 37 | 38 | Transmembrane Receptor UNC5H2-like |
| 12a | SC134999661_A | 39 | 40 | Thymosin-like |
| 13 | AC025256_da7 | 41 | 42 | Neuromodulin-like |
| 14a | CG56075-01 | 43 | 44 | Prostatin Precursor-like |
| 14b | CG56075-01 | 45 | 46 | Prostatin Precursor-like |

NOVX nucleic acids and their encoded polypeptides are useful in a variety of applications and contexts. The various NOVX nucleic acids and polypeptides according to the invention are useful as novel members of the protein families according to the presence of domains and sequence relatedness to previously described proteins. Additionally, NOVX nucleic acids and polypeptides can also be used to identify proteins that are members of the family to which the NOVX polypeptides belong.

NOV1 is homologous to a Human laminin alpha 5-like family of proteins. Thus, the NOV1 nucleic acids, polypeptides, antibodies and related compounds according to the invention will be useful in therapeutic and diagnostic applications implicated in, for example; Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration; Cholesteryl ester storage disease; Corneal dystrophy, Thiel-Behnke type; Dubin-Johnson syndrome; Leukemia, T-cell acute lymphocytic; Retinol binding protein, deficiency of; SEMD, Pakistani type; Spinocercbellar ataxia, infantile-onset, with sensory neuropathy; Split hand/foot malformation, type 3; Tolbutamidc poor metabolizer; Urofacial syndrome; Warfarin sensitivity; Wolman disease, neuroprotection, fertility, diabetes, autoimmune disease, renal artery stenosis, interstitial nephritis, glomerulonephritis, polycystic kidney disease, systemic lupus erythematosus, renal tubular acidosis, IgA nephropathy, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, ulcers, systemic lupus erythematosus, autoimmune disease, asthma, emphysema, scleroderma, allergy, ARDS, or other pathologies or conditions.

NOV2 is homologous to the Human flurpin/PI 13-like family of proteins. Thus NOV2 nucleic acids, polypeptides, antibodies and related compounds according to the invention will be useful in therapeutic and diagnostic applications implicated in Colorectal cancer, Combined factor V and VIII deficiency; Cone-rod retinal dystrophy-1; Leukemia/lymphoma, B-cell, 2; Lymphoma/leukemia, B-cell, variant; Protoporphyria, erythropoietic; Protoporphyria, erythropoietic, recessive, with liver failure; Obesity, autosomal dominant; Osteosarcoma; cancer, skin psoriasis, and/or other pathologies and disorders.

NOV3 is homologous to a family of Set Binding Factor (SBF1)-like proteins. Thus, the NOV3 nucleic acids and polypeptides, antibodies and related compounds according to the invention will be useful in therapeutic and diagnostic applications implicated in, for example: Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration; Cholesteryl ester storage disease; Corneal dystrophy, Thiel-Behnke type; Dubin-Johnson syndrome;

Leukemia, T-cell acute lymphocytic; Retinol binding protein, deficiency of; SEMD, Pakistani type; Spinocerebellar ataxia, infantile-onset, with sensory neuropathy; Split hand/foot malformation, type 3; Tolbutamide poor metabolizer; Urofacial syndrome; Warfarin sensitivity; Wolman disease, and/or other pathologies.

NOV4 is homologous to the TSPAN-1-like family of proteins. Thus, NOV4 nucleic acids, polypeptides, antibodies and related compounds according to the invention will be useful in therapeutic and diagnostic applications implicated in, for example: adrenoleukodystrophy, congenital adrenal hyperplasia, hemophilia, hypercoagulation, idiopathic thrombocytopenic purpura, autoimmune disease, allergies, asthma, immunodeficiencies, transplantation, graft versus host disease, Von Hippel-Lindau (VEL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, arthritis, tendonitis, fertility, atherosclerosis, aneurysm, hypertension, fibromuscular dysplasia, stroke, scleroderma, obesity, myocardial infarction, embolism, cardiovascular disorders, bypass surgery, cirrhosis, inflammatory bowel disease, diverticular disease, Hirschsprung's disease, Crohn's Disease, appendicitis, ulcers, diabetes, renal artery stenosis, interstitial nephritis, glomerulonephritis, polycystic kidney disease, systemic lupus erythematosus, renal tubular acidosis, IgA nephropathy, laryngitis, emphysema, ARDS, lymphedema, muscular dystrophy, myasthenia gravis, endometriosis, pancreatitis, hyperparathyroidism, hypoparathyroidism, growth and reproductive disorders, xerostomia, psoriasis, actinic keratosis, acne, hair growth/loss, allopecia, pigmentation disorders, endocrine disorders, tonsillitis, cystitis, incontinence, and/or other pathologies.

NOV5 is homologous to the Fatty Acid-Binding Protein, Epidermal-like family of proteins. Thus NOV5 nucleic acids, polypeptides, antibodies and related compounds according to the invention will be useful in therapeutic and diagnostic applications implicated in, fatty acid transport of skin, oral mucosa, and/or other disorders and conditions.

NOV6 is homologous to the Uncoupling Protein 1-like family of proteins. Thus NOV6 nucleic acids, polypeptides, antibodies and related compounds according to the invention will be useful in therapeutic and diagnostic applications implicated in, for example: obesity, hyperphagia, and/or other pathologies/disorders.

NOV7 is homologous to members of the Leucine-Rich Glioma-Inactivated Protein-like family of proteins. Thus, the NOV7 nucleic acids, polypeptides, antibodies and related compounds according to the invention will be useful in therapeutic and diagnostic applications implicated in, for example; uveitis and corneal fibroblast proliferation, allergic encephalomyelitis, amyotrophic lateral sclerosis, acute pancreatitis, cerebral cryptococcosis, autoimmune disease including Type I diabetes mellitus (DM), experimental allergic encephalomyelitis (EAE), systemic lupus erythematosus (SLE), colitis, thyroiditis and various forms of arthritis, cancer such as AML, bacterial infections, and/or other pathologies/disorders.

NOV8 is homologous to the RNase-like family of proteins. Thus, NOV8 nucleic acids and polypeptides, antibodies and related compounds according to the invention will be useful in therapeutic and diagnostic applications implicated in, for example; Diabetes, Von Hippel-Lindau (VHL) syndrome, Pancreatitis, Obesity, Hyperthyroidism and Hypothyroidism and Cancers including, but no limited to Thyroid and Pancreas, and/or other pathologies/disorders.

NOV9 is homologous to the Insulin like growth factor binding protein-like family of proteins. Thus, NOV9 nucleic acids and polypeptides, antibodies and related compounds according to the invention will be useful in therapeutic and diagnostic applications implicated in diabetes, obesity, Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, cirrhosis, transplantation, hemophilia, hypercoagulation, idiopathic thrombocytopenic purpura, autoimmune disease, allergies, immunodeficiencies, graft versus host disease (GVHD), lymphaedema, and/or other pathologies or disorders.

NOV10 is homologous to the Pregnancy Zone Protein Precursor-like family of proteins. Thus, NOV10 nucleic acids and polypeptides, antibodies and related compounds according to the invention will be useful in pregnancy, hypertensive toxemia, pre-eclampsia/eclampsia (gestational proteinuric hypertension), glomerular endotheliosis, cholestasis, and pruritic urticarial papules and plaques of pregnancy, and/or other pathologies or disorders.

NOV11 is homologous to the Transmembrane Receptor UNC5H2-like family of proteins. Thus, NOV11 nucleic acids and polypeptides, antibodies and related compounds according to the invention will be useful in therapeutic and diagnostic applications implicated in various pathologies or disorders.

NOV12 is homologous to the Thymosin-like family of proteins. Thus, NOV12 nucleic acids and polypeptides, antibodies and related compounds according to the invention will be useful in therapeutic and diagnostic applications implicated in, for example; osteoporosis, osteoarthritis, cardiac hypertrophy, atherosclerosis, hypertension, restenosis, and/or other pathologies/disorders.

NOV13 is homologous to the Neuromodulin-like family of proteins. Thus, NOV13 nucleic acids and polypeptides, antibodies and related compounds according to the invention will be useful in therapeutic and diagnostic applications implicated in various pathologies/disorders.

NOV14 is homologous to the Prostatin Precursor-like family of proteins. Thus, NOV14 nucleic acids and polypeptides, antibodies and related compounds according to the invention will be useful in therapeutic and diagnostic applications implicated in Cardiomyopathy, Atherosclerosis, Hypertension, Congenital heart defects, Aortic stenosis, Atrial septal defect (ASD), Atrioventricular (A-V) canal defect, Ductus arteriosus, Pulmonary stenosis, Subaortic stenosis, Ventricular septal defect (VSD), valve diseases, Tuberous sclerosis, Scleroderma, Obesity, Transplantation, and/or other pathologies/disorders.

The NOVX nucleic acids and polypeptides can also be used to screen for molecules, which inhibit or enhance NOVX activity or function. Specifically, the nucleic acids and polypeptides according to the invention may be used as targets for the identification of small molecules that modulate or inhibit, e.g., neurogenesis, cell differentiation, cell proliferation, hematopoiesis, wound healing and angiogenesis.

Additional utilities for the NOVX nucleic acids and polypeptides according to the invention are disclosed herein.

NOV1

NOV1 includes three novel human laminin alpha 5-like proteins disclosed below. The disclosed sequences have been named NOV1a, NOV1b, and NOV1c.

NOV1a

A disclosed NOV1a nucleic acid of 10809 nucleotides (also referred to as CG55974-01) encoding a human laminin alpha 5-like protein is shown in Table 1A. An open reading frame was identified beginning with an ATG initiation codon at nucleotides 1–3 and ending with a TAG codon at nucleotides 10801–10803. A putative untranslated region downstream from the termination codon is underlined in Table 1A. The start and stop codons are in bold letters.

TABLE 1A

NOV1a nucleotide sequence (SEQ ID NO:1).

ATGGCGAAGCGGCTCTGCGCGGGGAGCGCACTGTGTGTTCGCGGCCCCCGGGGCCCCGCGCCGCTGCTGCTG
CACCCGCCCTACTTCAACCTGGCCGAGGGCGCCCGCATCGCCGCCTCCGCGACCTGCGGAGAGGAGGCCCCG
GCGCGCGGCTCCCCGCGCCCCACCGAGGACCTTTACTGCAAGCTGGTAGGGGGCCCCGTGGCCGGCGGCGAC
CCCAACCAGACCATCCAGGGCCAGTACTGTGACATCTGCACGGCTGCCAACAGCAACAAGGCACACCCCGCG
AGCAATGCCATCGATGGCACGGAGCGCTGGTGGCAGAGTCCACCGCTGTCCCGCGGCCTGGAGTACAACGAG
GTCAACGTCACCCTGGACCTGGGCCAGGTCTTCCACGTGGCCTACGTCCTCATCAAGTTTGCCAACTCACCC
CGGCCGGACCTCTGGGTGCTGGAGCGGTCCATGGACTTCGGCCGCACCTACCAGCCCTGGCAGTTCTTTGCC
GCCTCCAAGAGGGACTGTCTGGAGCGGTTCGGGCCACAGACGCTGGAGCGCATCACACGGGACGACGCGGCC
ATCTGCACCACCGAGTACTCACGCATCGTGCCCCTGGAGAACGGAGAGATCGTGGTGTCCCTGGTGAACGGA
CGTCCGGGCGCCATGAATTTCTCCTACTCGCCGCTGCTACGTGAGTTCACCAAGGCCACCAACGTCCGCCTG
CGCTTCCTGCGTACCAACACGCTGCTGGGCCATCTCATGGGGAAGGCGCTGCGGGACCCCACGGTCACCCGC
CGGTATTATTACAGCATCAAGGATATCAGCATCGGAGGCCGCTGTGTCTGCCACGGCCACGCGGATGCCTGC
GATGCCAAAGACCCCACGGACCCGTTCAGGCTGCAGTGCACCTGCCAGCACAACACCTGCGGGGGCACCTGC
GACCGCTGCTGCCCCGGCTTCAATCAGCAGCCGTGGAAGCCTGCGACTGCCAACAGTGCCAACGAGTGCCAG
TGTGAGTGCTACGGCCATGCCACCGACTGTTACTACGACCCTGAGGTGGACCGGCGCCGCGCCAGCCAGAGC
CTGGATGGCACCTATCAGGGTGGGGGTGTCTGTATCGACTGCCAGCACCACACCACCGGCGTCAACTGTGAG
CGCTGCCTGCCCGGCTTCTACCGCTCTCCCAACCACCCCTCTCGACTCGCCCCACGTCTGCCGCGGCTGCAAC
TGCGAGTCCGACTTCACGGATGGCACCTGCGAGGACCTGACGGGTCGATGCTACTGCCGGCCCAACTTCTCT
GGGGAGCGGTGTGACGTGTGTGCCGAGGGCTTCACGGGCTTCCCAAGCTGCTACCGTGAGCACCTGCCAGGG
AATGACACCAGGGAGCAGGTGCTGCCAGCCGGCCAGATTGTGAGTTGTGACTGCAGCGCGGCAGGGACCCAG
GGCAACGCCTGCCGGAAGGACCCAAGGGTGGGACGCTGTCTGTGCAAACCCAACTTCCAAGGCACCCATTGT
GAGCTCTGCGCGCCAGGGTTCTACGGCCCCGGCTGCCCTGCCAGTGTTCCAGCCCTGGAGTGGCCGATGACC
GCTGTGACCCTGACACAGGCCAGTGCAGGTGCCGAGTGGGCTTCGAGGGGGCCACATGTGATCGCTGTGCCC
CCGGCTACTTTCACTTCCCTCTCTGCCAGTCACCCGCTCCGCTCTGCAGTGTGTGGCTGCAGCCCTGCAGGA
ACCTTGCCCGAGGGCTGCGATGAGGCCGGCCGCTGCCTATGCCAGCCTGAGTTTGCTGGACCTCATTGTGAC
CGGTGCCGCCCTGGCTACCATGGTTTCCCCAACTGCGCAGCATGCACCTGCGACCCTCGGGGAGCCCTGGAC
CAGCTCTGTGGGCGGGAGGTTTGTGCCGCTGCCGCCCCGGCTACACAGGCACTGCCTGCCAGGAATGCAGC
CCCGGCTTTCACGGCTTCCCCAGCTGTCCTGCCACTGCTCTGCTGAAGGCTCCCTGCACGCAGCCTGTGACC
CCCGGAGTGGGCAGTGCAGCTGCCGGCCCCGTGCGGGGCTGCGGTGTGACACATGTGTGCCCGGTGCCTACA
ACTTCCCCTACTGCGAAGCCTCTCTTCACAGCTGGCTCTTGCCACCCTGCCGGTCTGGCCCCAGTGGATCCT
GCCCTTCCTGAGGTGAGCCCACCCTGTATGTGCCGGGCTCACGTGGAGGGGCCGAGCTGTGACCGCTGCAAA
CCTGGGTTCTGGGGACTGAGCCCCAGCAACCCCGAGGGCTGTACCCGTTGCAGCTGCGACCTCAGGGGCACA
CTGGGTGGAGTTGCTGAGTGCCAGGGCACCGGCCAGTGCTTCTGCAAGCCCCACGTGTGCGGCCAGGCCTGC
GCGTCCTGCAAGGATGGCTTCTTTGGACTGGATCAGGCTGACTATTTTGGCTGCCGCAGTTGCCGGTGTGAC
ATTGGCGGTGCACTGGGCCAGAGCTGTGAACCGAGGACGGGCGTCTGCCGGTGCCGCCCCAACACCCAGGGC

TABLE 1A-continued

NOV1a nucleotide sequence (SEQ ID NO:1).

CCCACCTGCAGCGAGCCTGCGAGGGACCACTACCTCCCGGACCTGCACCACCTGCGCCTGGAGCTGGAGGAG
GCTGCCACACCTGAGGGTCACGCCGTGCGCTTTGGCTTCAACCCCCTCGAGTTCGAGAACTTCAGCTGGAGG
GGCTACGCGCAGATGGCACCTGTCCAGCCCAGGATCGTGGCCAGGCTGAACCTGACCTCCCCTGACCTTTTC
TGGCTCGTCTTCCGATACGTCAACCGGGGGGCCATGAGTGTGAGCGGGCGGGTCTCTGTGCGAGAGGAGGGC
AGGTCGGCCACCTGCGCCAACTGTACAGCACAGAGTCAGCCCGTGGCCTTCCCACCCAGCACGGAGCCTGCC
TTCATCACCGTGCCCCAGAGGGGCTTCGGAGAGCCCTTTGTGCTGAACCCTGGCACCTGGGCCCTGCGTGTG
GAGGCCGAAGGGGTGCTCCTGGACTACGTGGTTCTGCTGCCTAGCGCATACTACGAGGCGGCGCTCCTGCAG
CTGCGGGTGACTGAGGCCTGCACATACCGTCCCTCTGCCCAGCAGTCTCCCCCCAGCTGCCTCCTCTACACA
CACCTCCCCCTGGATGGCTTCCCCTCGGCCGCCGGGCTGGAGGCCCTGTGTCGCCAGGACAACAGCCTGCCC
CGGCCCTGCCCCACGGAGCAGCTCAGCCCGTCGCACCCGCCACTGATCACCTGCACGGGCAGTGATGTGGAC
GTCCAGCTTCAAGTGGCAGTGCCACAGCCAGGCCGCTATGCCCTAGTGGTGGAGTACGCCAATGAGGATGCC
CGCCAGGAGGTGGGCGTGGCCGTGCACACCCCACAGCGGGCCCCCCAGCAGGGGCTGCTCTCCCTGCACCCC
TGCCTGTACAGCACCCTGTGCCGGGGCACTGCCCGGGATACCCAGGACCACCTGGCTGTCTTCCACCTGGAC
TCGGAGGCCAGCGTGAGGCTCACAGCCGAACAGGCACGCTTCTTCCTGCACGGGGTCACTCTGGTGCCCATT
GAGGAGTTCAGCCCGGAGTTCGTGGAGCCCCGGGTCAGCTGCATCAGCAGCCACGGCGCCTTTGGCCCCAAC
AGTGCCGCCTGTCTGCCCTCGCGCTTCCCAAAGCCGCCCCAGCCCATCATCCTCAGGGACTGCCAGGTGATC
CCGCTGCCGCCCGGCCTCCCGCTGACCCACGCGCAGGATCTCACTCCAGCCATGTCCCCAGCTGGACCCCGA
CCTCGGCCCCCCACCGCTGTGGACCCTGATGCAGAGCCCACCCTGCTGCGTGAGCCCCAGGCCACCGTGGTC
TTCACCACCCATGTGCCCACGCTGGGCCGCTATGCCTTCCTGCTGCACGGCTACCAGCCAGCCCACCCCACC
TTCCCCGTGGAAGTCCTCATCAACGCCGGCCGCGTGTGGCAGGGTCACGCCAACGCCAGCTTCTGTCCACAT
GGCTACGGCTGCCGCACCCTGGTGGTGTGTGAGGGCCAGGCCCTGCTGGACGTGACCCACAGCGAGCTCACT
GTGACCGTGCGTGTGCCCAAGGGCCGGTGGCTCTGGCTGGATTATGTACTCGTGGTCCCTGAGAACGTCTAC
AGCTTTGGCTACCTCCGGGAGGAGCCCCTGGATAAATCCTATGACTTCATCAGCCACTGCGCAGCCCAGGGC
TACCACATCAGCCCCAGCAGCTCATCCCTGTTCTGCCGAAACGCTGCTGCTTCCCTCTCCCTCTTCTATAAC
AACGGAGCCCGTCCATGTGGCTGCCACGAAGTAGGTGCTACAGGCCCCACGTGTGAGCCCTTCGGGGGCCAG
TGTCCCTGCCATGCCCATGTCATTGGCCGTGACTGCTCCCGCTGTGCCACCGGATACTGGGGCTTCCCCAAC
TGCAGGGCCTGTGACTGCGGTGCCCGCCTCTGTGACGAGCTCACGGGCCAGTGCATCTGCCCGCCACGCACC
ATCCCGCCCGACTGCCTGCTGTGCCAGCCCCAGACCTTTGGCTGCCACCCCCTGGTCGGCTGTGAGGAGTGT
AACTGCTCAGGGCCCGGCATCCAGGAGCTCACAGACCCTACCTGTGACACAGACAGCGGCCAGTGCAGGTGC
AGACCCAACGTGACTGGGCGCCGCTGTGATACCTGCTCTCCGGGCTTCCATGGCTACCCCGCTGCCGCCCC
TGTGACTGTCACGAGGCGGGCACTGCGCCTGGCGTGTGTGACCCCCTCACAGGGCAGTGCTACTGTAAGGAG
AACGTGCAGGGCCCCAAATGTGACCAGTGCAGCCTTGGGACCTTCTCACTGGATGCTGCCAACCCCAAAGGT
TGCACCCGCTGCTTCTGCTTTGGGGCCACGGAGCGCTGCCGGAGCTCGTCCTACACCCGCCAGGAGTTCGTG
GATATGGAGGGATGGGTGCTGCTGAGCACTGACCGGCAGGTGGTGCCCCACGAGCGGCAGCCAGGGACGGAG
ATGCTCCGTGCAGACCTGCGGCACGTGCCTGAGGCTGTGCCCGAGGCTTTCCCCGAGCTGTACTGGCAGGCC
CCACCCTCCTACCTGGGGGACCGGGTAAGCTCCTACGGTGGGACCCTCCGTTATGAACTGCACTCAGAGACC
CAGCGGGGAGATGTCTTTGTCCCCATGGAGAGCAGGCCGGATGTGGTGCTGCAGGGCAACCAGATGAGCATC
ACATTCCTGGAGCCGGCATACCCCACGCCTGGCCACGTTCACCGTGGGCAGCTGCAGCTGGTGGAGGGGAAC
TTCCGGCATACGGAGACGCGCAACACTGTGTCCCGCGAGGAGCTCATGATGGTGCTGGCCAGCCTGGAGCAG

TABLE 1A-continued

NOV1a nucleotide sequence (SEQ ID NO:1).

```
CTGCAGATCCGTGCCCTCTTCTCACAGATCTCCTCGGCTGTCTTCCTGCGCAGGGTGGCACTGGAGGTGGCC
AGCCCAGCAGGCCAGGGGCCCTGGCCAGCAATGTGGAGCTGTGCCTGTGCCCCGCCAGCTACCGGGGGGAC
TCATGCCAGGAATGTGCCCCCGGCTTCTATCGGGACGTCAAAGGTCTCTTCCTGGGCCGATGTGTCCCTTGT
CAGTGCCATGGACACTCAGACCGCTGCCTCCCTGGCTCTGGCGTCTGTGTGTGCCAGCACAACACCGAAGGG
GCCCACTGTGAGCGCTGCCAGGCTGGCTTCGTGAGCAGCAGGGACGACCCCAGCGCCCCTGTGTCAGCTGC
CCCTGCCCCCTCTCAGTGCCTTCCAACAGGTGTGCGCCCGGATTCTTTGGGAACCCACTGGTGCTGGGCAGC
TCCTGCCAGCCATGCGACTGCAGCGGCAACGGTGACCCCAACTTGCTCTTCAGCGACTGCGACCCCCTGACG
GGCGCCTGCCGTGGCTGCCTGCGCCACACCACTGGGCCCCGCTGCGAGATCTGTGCCCCCGGCTTCTACGGC
AACGCCCTGCTGCCCGGCAACTGCACCCGTTGCGACTGTACCCCATGTGGGACAGAGGCCTGCGACCCCCAC
AGCGGGCACTGCCTGTGCAAGGCGGGCGTGACTGGGCGGCGCTGTGACCGCTGCCAGGAGGGACATTTTGGT
TTCGATGGCTGCGGGGCTGCCGCCCGTGTGCTTGTGGACCGGCCGCCGAGGGCTCCGAGTGCCACCCCCAG
AGCGGACAGTGCCACTGCCGACCAGGGACCATGGGACCCCAGTGCCGCGAGTGTGCCCCTGGCTACTGGGGG
CTCCCTGAGCAGGGCTGCAGGCGTTGCCAGTGCCCTGGGGCCGCTGTGACCCTCACACGGGCCGCTGCAAC
TGCCCCCCGGGGCTCAGCGGGGAGCGCTGCGACACCTGCAGCCAGCAGCATCAGGTGCCTGTTCCAGGCGGG
CCTGTGGGCCACAGCATCCACTGTGAAGTGTGTGACCACTGTGTGGTCCTGCTCCTGGATGACCTGGAACGG
GCCGGCGCCCTCCTCCCCGCCATTCACGAGCAACTGCGTGGCATCAATGCCAGCTCCATGGCCTGGGCCCGT
CTGCACAGGCTGAACGCCTCCATCGCTGACCTGCAGGTACTGAGCGTCCTGGCCTTCCCTCCCCAACCCGGG
CCAGTGCAGGCCTTCACCTTTCGCCTCCCACAGAGCCAGCTCCGGAGCCCCCTGGGCCCCCGCCATGAGACG
GCACAGCAGCTGGAGGTGCTGGAGCAGCAGAGCACAAGCCTTCCTCCACAGGCCGTGGGGACCCGAGACCAG
GCGAGCCAATTGCTGGCCGGCACCGAGGCCACACTGGGCCATGCGAAGACGCTGTTGGCGGCCATCCGGGCT
GTGGACCGCACCCTGAGCGAGCTCATGTCCCAGACGGGCCACCTGGGGCTGGCCAATGCCTCGGCTCCATCA
GGTGAGCAGCTGCTCCGGACACTGGCCGAGGTGGAGCGGCTGCTCTGGGAGATGCGGGCCCGGGACCTGGGG
GCCCCGCAGGCAGCAGCTGAGGCTGAGTTGGCTGCAGCACAGAGAGTGCTGGCCCGGGTGCAGGAGCAGCTG
AGCAGCCTCTGGGAGGAGAACCAGGCACTGGCCACACAAACCCGCGACCGGCTGGCCCAGCACGAGGCCGGC
CTCATGGACCTGCGAGAGGCTTTGAACCGGGCAGTGGACGCCACACGGGAGGCCCAGGAGCTCAACAGCCGC
AACCAGGAGCGCCTGGAGGAAGCCCTGCAAAGGAAGCAGGAGCTGTCCCGGGACAATGCCACCCTGCAGGCC
ACTCTGCATGCGGCTAGGGACACCCTGGCCAGCGTCTTCAGATTGCTGGAGGGGCTAAGTCCACTCAAATTC
CAGGAGCTGGAGCGCCTCGCCGCCAGCCTGGATGGGCTCGGACCCCACTGCTGCAGAGGATGCAGACCTTC
TCCCCGGCGGGCAGCAAGCTGCGTCTAGTGGAGGCCGCCGAGGCCCACGCACAGCAGCTGGGCCAGCTGGCA
CTCAATCTGTCCATCATCCTGGACGTCAACCAGGACCGCCTCACCCAGAGGGCCATCGAGGCCTCCAACGCC
TACAGCCGCATCCTGCAGGCCGTGCAGGCTGCCGAGGATGCTGCTGGCCAGGCCCTGCAGCAGGCGGACCAC
ACGTGGCAGACGGTGGTGCGGCAGGGCCTGGTGGACCGAGCCCAGCAGCTCCTGGCCAACAGCACTGCACTA
GAAGAGGCCATGCTCCAGGAACAGCAGAGGCTGGGCCTTGGTGAGTGCTGGGCTCCGATGGGGGCCCTTAGG
CCTGCTGGGACCCAGCTCCGAGATGTCCGGGCCAAGAAGGACCAGCTGGAGGCGCACATCCAGGCGGCGCAG
GCCATGCTTGCCATGGACACAGGTGAGACAAGCAAGAAGATCGCACATGCCAAGGCTGTGGCTGCTGAAGCC
CAGGACACCGCAACCCGTGTGCAGTCCCAGCTGCAGGCCATGCAGGAGAATGTGGAGCGGTGGCAGGGCCAG
TACGAGGGCCTGCGGGCCAGGACCTGGGCCAGGCAGTGCTTGACGCAGGCTCTGCAGTGTCCACCCTGGAG
AAGACGCTGCCCCAGCTGCTGGCCAAGCTGAGCATCCTGGAGAACCGTGGGGTGCACAACGCCAGCCTGGCC
```

TABLE 1A-continued

NOV1a nucleotide sequence (SEQ ID NO:1).

CTGTCCGCCAGCATTGGCCGCGTGCGAGAGCTCATTGCCCAGGCCCGGGGGCTGCCAGTAAGGTGGTCAAG
GTGCCCATGAAGTTCAACGGGCGCTCAGGGGTGCAGCTGCGCACCCCACGGGATCTTGCCGACCTTGCTGCC
TACACTGCCCTCAAGTTCTACCTGCAGGGCCCAGAGCCTGAGCCTGGGCAGGGTACCGAGGATCGCTTTGTG
ATGTACATGGGCAGCCGCCAGGCCACTGGGGACTACATGGGTGTGTCTCTGCGTGACAAGAAGGTGCACTGG
GTGTATCAGCTGGGTGAGGCGGGCCCTGCAGTCCTAAGCATCGATGAGGACATTGGGGAGCAGTTCGCAGCT
GTCAGCCTGGACAGGACTCTCCAGTTTGGCCACATGTCCGTCACAGTGGAGAGACAGATGATCCAGGAAACC
AAGGGTGACACGGTGGCCCCTGGGGCAGAGGGGCTGCTCAACCTGCGGCCAGACGACTTCGTCTTCTACGTC
GGGGGGTACCCCAGTACCTTCACGCCCCCTCCCCTGCTTCGCTTCCCCGGCTACCGGGGCTGCATCGAGATG
GACACGCTGAATGAGGAGGTGGTCAGCCTCTACAACTTCGAGAGGACCTTCCAGCTGGACACGGCTGTGGAC
AGGCCTTGTGCCCGGTCCAAGTCGACCGGGGACCCGTGGCTCACGGACGGCTCCTACCTGGACGGCACCGGC
TTCGCCCGCATCAGCTTCGACAGTCAGATCAGCACCACCAAGCGCTTCGAGCAGGAGCTGCGGCTCGTGTCC
TACAGCGGGGTGCTCTTCTTCCTGAAGCAGCAGAGCCAGTTCCTGTGCTTGGCCGTGCAAGAAGGCAGCCTC
GTGCTGTTGTATGACTTTGGGGCTGGCCTGAAAAAGGCCGTCCCACTGCAGCCCCCACCGCCCCTGACCTCG
GCCAGCAAGGCGATCCAGGTGTTCCTGCTGGGGGGCAGCCGCAAGCGTGTGCTGGTGCGTGTGGAGCGGGCC
ACGGTGTACAGCGTGGAGCAGGACAATGATCTGGAGCTGGCCGACGCCTACTACCTGGGGGGCGTGCCGCCC
GACCAGCTGCCCAGCCTGCGACGGCTCTTCCCCACCGGAGGCTCAGTCCGTGGCTGCGTCAAAGGCATCAAG
GCCCTGGGCAAGTATGTGGACCTCAAGCGGCTGAACACGACAGGCGTGAGCGCCGGCTGCACCGCCGACCTG
CTGGTGGGGCGCGCCATGACTTTCCATGGCCACGGCTTCCTTCGCCTGGCGCTCTCGAACGTGGCACCGCTC
ACTGGCAACGTCTACTCCGGCTTCGGCTTCCACAGCGCCCAGGACAGTGCCCTGCTCTACTACGGGCGTCC
CCGGTGAGACCTCACCAGGTGTCCCTGCAGCAGGGCCGTGTGAGCCTACAGCTCCTGAGGACTGAAGTGAAA
ACTCAAGCGGGCTTCGCCGATGGTGCCCCCCATTACGTCGCCTTCTACAGCAATGCCACGGGGGTCTGGCTG
TATGTCGATGACCAGCTCCAGCAGATGAAGCCCCACCGGGACCACCCCCCGAGCTCCAGCCGCAGCCTGAG
GGGCCCCCGAGGCTCCTCCTGGGAGGCCTGCCTGAGTCTGGCACCATTTACAACTTCAGTGGCTGCATCAGC
AACGTCTTCGTGCAGCGGCTCCTGGGCCCACAGCGCGTATTTGATCTGCAGCAGAACCTGGGCAGCGTCAAT
GTGAGCACGGGCTGTGCACCCGCCCTGCAAGCCCAGACCCCGGGCCTGGGGCCTAGACAGGCCTCCCGCCGC
AGCCGTCAGCCCGCCCGGCATCCTGCCTGCATGCTGCCCCCACACCTCAGGACCACCCGAGACTCCTACCAG
TTTGGGGGTTCCCTGTCCAGTCACCTGGAGTTTGTGGGCATCCTGGCCCGACATAGGAACGTCTCCGTGCGC
TGGGAGAAGAACCGGATCCTGCTGGTGACGGACGGGCCCGGGCCTGAAGCCAGGAGGGGCCGCACCGGCAG
CACCAGGGGGCAGAGCACCCCCAGCCCCACACCCTCTTTGTGGGCGGCCTCCCGGCCAGCAGCCACAGCTCC
AAACTTCCGGTGACCGTCGGGTTCAGCGGCTGTGTGAAGAGACTGAGGCTGCACGGGAGGCCCCTGGGGCC
CCCACACGGATGGCAGGGGTCACACCCTGCATCTTGGGCCCCTGGAGGCGGGCCTGTTCTTCCCAGGCAGC
GGGGGAGTTATCACTTTAGGTCTGCCAGGAGCTACACTGCCTGATGTGGGCCTGGAACTGGAGGTGCGGCCC
CTGGCAGTCACCGGACTGATCTTCCACTTGGGCCAGGCCCGGACGCCCCCCTACTTGCAGTTGCAGGTGCTA
CCCCGCCAGGTCCTGCTGCGGGCGGATGACGGAGCAGGGGAGTTCTCCACGTCAGTGACCCGCCCCTCAGTG
CTGTGTGATGGCCAGTGGCACCGGCTAGCGGTGATGAAAAGCGGGAATGTGCTCCGGCTGGAGGTGGACGCG
CAGAGCAACCACACCGTGGGCCCCTTGCTGGCGGCTGCAGCTGGTGCCCCAGCCCCTCTGTACCTCGGGGGC
CTGCCTGAGCCCATGGCCGTGCAGCCCTGGCCCCCCGCCTACTGCGGCTGCATGAGGAGGCTGGCGGTGAAC
CGGTCCCCCGTCGCCATGACTCGCTCTGTGGAGGTCCACGGGGCAGTGGGGGCCAGTGGCTGCCCAGCCGCC
TAG<u>AATAAA</u>

In a search of public sequence databases, the NOV1a nucleic acid sequence, located on chromsome 20 is 80% identical to a gb:GENBANK-ID:MMU37501|acc:U37501.1 *Mus musculus* laminin alpha 5 chain (Lama5) mRNA, and 61% identical to a gb:GENBANK-ID:DROLAMZ|acc:L07288.1 *Drosophila melanogaster* laminin A (Lam-A) mRNA. Public nucleotide databases include all GenBank databases and the GeneSeq patent database.

In all BLAST alignments herein, the "E-value" or "Expect" value is a numeric indication of the probability that the aligned sequences could have achieved their similarity to the BLAST query sequence by chance alone, within the database that was searched. For example, the probability that the subject ("Sbjct") retrieved from the NOV1 BLAST analysis, e.g., *Mus musculus* laminin alpha 5 chain (Lama5) mRNA, matched the Query NOV1 sequence purely by chance is 0.0. The Expect value (E) is a parameter that describes the number of hits one can "expect" to see just by chance when searching a database of a particular size. It decreases exponentially with the Score (S) that is assigned to a match between two sequences. Essentially, the E value describes the random background noise that exists for matches between sequences.

The Expect value is used as a convenient way to create a significance threshold for reporting results. The default value used for blasting is typically set to 0.0001. In BLAST 2.0, the Expect value is also used instead of the P value (probability) to report the significance of matches. For example, an E value of one assigned to a hit can be interpreted as meaning that in a database of the current size one might expect to see one match with a similar score simply by chance. An E value of zero means that one would not expect to see any matches with a similar score simply by chance. See, e.g., the website of National Center for Biotechnology Information ("NCBI"), education/blastinfo. Occasionally, a string of X's or N's will result from a BLAST search. This is a result of automatic filtering of the query for low-complexity sequence that is performed to prevent artifactual hits. The filter substitutes any low-complexity sequence that it finds with the letter "N" in nucleotide sequence (e.g., "NNNNNNNNNNNN") or the letter "X" in protein sequences (e.g., "XXXX"). Low-complexity regions can result in high scores that reflect compositional bias rather than significant position-by-position alignment. (Wootton and Federhen, Methods Enzymol 266:554–571, 1996).

The disclosed NOV1a polypeptide (SEQ ID NO:2) encoded by SEQ ID NO:1 has 3600 amino acid residues and is presented in Table 1B using the one-letter amino acid code. Signal P, Psort and/or Hydropathy results predict that NOV1a has a signal peptide and is likely to be localized extracellularly with a certainty of 0.8200. In other embodiments, NOV1a may also be localized to the lysosome (lumen) with acertainty of 0.1900, the endoplasmic reticulum (membrane) with a certainty of 0.1000 or in the endoplasmic reticulum (lumen) with a certainty of 0.1000. The most likely cleavage site for a NOV1a peptide is between amino acids 14 and 15, at: CVRGP.

TABLE 1B

Encoded NOV1a protein sequence (SEQ ID NO:2).

MAKRLCAGSALCVRGPRGPAPLLLHPPYFNLAEGARIAASATCGEEAPARGSPRFTEDLYCKLV

GGPVAGGDPNQTIQGQYCDICTAANSNKAHPASNAIDGTERWWQSPPLSRGLEYNEVNVTLDLG

QVFHVAYVLIKFANSPRPDLWVLERSMDFGRTYQPWQFFAASKRDCLERFGPQTLERITRDDAA

ICTTEYSRIVPLENGEIVVSLVNGRPGAMNFSYSPLLREFTKATNVRLRFLRTNTLLGHLMGKA

LRDPTVTRRYYYSIKDISIGGRCVCHGHADACDAKDPTDPFRLQCTCQHNTCGGTCDRCCPGFN

QQPWKPATANSANECQCECYGHATDCYYDPEVDRRRASQSLDGTYQGGGVCIDCQHHTTGVNCE

RCLPGFYRSPNHPLDSPHVCRGCNCESDFTDGTCEDLTGRCYCRPNFSGERCDVCAEGFTGFPS

CYREHLPGNDTREQVLPAGQIVSCDCSAAGTQGNACRKDPRVGRCLCKPNFQGTHCELCAPGFY

GPGCPASVPALEWPMTAVTLTQASAGAEWASRGPHVIAVPPATFTSLSASHPLRSAVCGCSPAG

TLPEGCDEAGRCLCQPEFAGPHCDRCRPGYHGFPNCAACTCDPRGALDQLCGAGGLCRCRPGYT

GTACQECSPGFHGFPSCPATALLKAPCTQPVTPGVGSAAAGPVRGCGVTHVCPVPTTSPTAKPL

FTAGSCHPAGLAPVDPALPEVSPPCMCPAHVEGPSCDRCKPGFWGLSPSNPEGCTRCSCDLRGT

LGGVAECQGTGQCFCKPHVCGQACASCKDGFFGLDQADYFGCRSCRCDIGGALGQSCEPRTGVC

RCRPNTQGFTCSEPARDHYLFDLHHLRLELEEAATPEGHAVRFGFNPLEFENFSWRGYAQMAPV

QPRIVARLNLTSPDLFWLVFRYVNRGANSVSGRVSVREEGRSATCANCTAQSQPVAFFPSTEPA

FITVPQRGFGEPFVLNPGTWALRVEAEGVLLDYVVLLPSAYYEAALLQLRVTEACTYRPSAQQS

PPSCLLYTHLPLDGFPSAAGLEALCRQDNSLPRFCPTEQLSPSHPPLITCTGSDVDVQLQVAVP

QPGRYALVVEYANEDARQEVGVAVHTPQRAPQQGLLSLHPCLYSTLCRGTARDTQDHLAVFHLD

SEASVRLTAEQARFFLHGVTLVPIEEFSFEFVEPRVSCISSHGAFGPNSAACLPSRFPKPPQPI

TABLE 1B-continued

Encoded NOV1a protein sequence (SEQ ID NO:2).

ILRDCQVIPLPPGLPLTHAQDLTPAMSPAGPRPRPPTAVDPDAEPTLLREPQATVVFTTHVPTL

GRYAFLLHGYQPAHFTFPVEVLINAGRVWQGHANASFCPHGYGCRTLVVCEGQALLDVTHSELT

VTVRVPKGRWLWLDYVLVVFENVYSFGYLREEPLDKSYDFISHCAAQGYHISPSSSSLFCRNAA

ASLSLFYNNGARPCGCHEVGATGPTCEFFGGQCPCHAHVIGRDCSRCATGYWGFPNCRACDCGA

RLCDELTGQCICPPRTIPPDCLLCQPQTFGCHPLVGCEECNCSGPGIQELTDPTCDTDSGQCRC

RPNVTGRRCDTCSPGFHGYPRCRPCDCHEAGTAPCVCDPLTGQCYCKENVQGPKCDQCSLGTFS

LDAANPKGCTRCFCFGATERCRSSSYTRQEFVDMEGWVLLSTDRQVVFHERQFGTEMLRADLRH

VPEAVPEAFPELYWQAPFSYLGDRVSSYGGTLRYELHSETQRGDVFVFMESRPDVVLQGNQMSI

TFLEPAYPTPGHVHRGQLQLVEGNFRHTETRNTVSREELMMVLASLEQLQIRALFSQISSAVFL

RRVALEVASPAGQGALASNVELCLCPASYRGDSCQECAPGFYRDVKGLFLGRCVPCQCHGHSDR

CLPGSGVCVCQHNTEGAHCERCQAGFVSSRDDPSAPCVSCPCFLSVPSNRCAPGFFGNPLVLGS

SCQPCDCSCNGDPNLLFSDCDPLTGACRGCLRHTTGFRCEICAPGFYGNALLPGNCTRCDCTFC

GTEACDPHSGHCLCKAGVTGRRCDRCQEGHFCFDGCCCCRPCACGPAAEGSECHPQSGQCHCRP

GTMGPQCRECAPGYWGLPEQGCRRCQCPGGRCDPHTGRCNCPPGLSGERCDTCSQQHQVPVPGG

PVGHSIHCEVCDHCVVLLLDDLERAGALLPAIHEQLRGINASSMAWARLHRLNASIADLQVLSV

LAFPPQPGPVQAFTFRLFQSQLRSPLGPRHETAQQLEVLEQQSTSLPPQAVGTRDQASQLLAGT

EATLGHAKTLLAAIRAVDRTLSELMSQTGHLGLANASAPSGEQLLRTLAEVERLLWEMRARDLG

APQAAAEAELAAAQRVLARVQEQLSSLWEENQALATQTRDRLAQHEAGLMDLREALNRAVDATR

EAQELNSRNQERLEEALQRKQELSRDNATLQATLHAARDTLASVFRLLEGLSPLKFQELERLAA

SLDGARTPLLQRMQTFSPAGSKLRLVEAAEAHAQQLGQLALNLSIILDVNQDRLTQRAIEASNA

YSRILQAVQAAEDAAGQALQQADHTWQTVVRQGLVDRAQQLLANSTALEEAMLQEQQRLGLGEC

WAPMGALRPAGTQLRDVRAKKDQLEAHIQAAQAMLAMDTGETSKKIAHAKAVAAEAQDTATRVQ

SQLQAMQENVERWQGQYEGLRGQDLGQAVLDAGSAVSTLEKTLPQLLAKLSILENRGVHNASLA

LSASIGRVRELIAQARGAASKVVKVPMKFNGRSGVQLRTPRDLADLAAYTALKFYLQGPEPEPG

QGTEDRFVMYMGSRQATGDYMGVSLRDKKVHWVYQLGEAGPAVLSTDEDIGEQFAAVSLDRTLQ

FGHMSVTVERQMIQETKGDTVAPGAEGLLNLRFDDFVFYVGCYPSTFTPPPLLRFFGYRGCIEM

DTLNEEVVSLYNFERTFQLDTAVDRPCARSKSTGDPWLTDGSYLDGTGFARISFDSQISTTKRF

EQELRLVSYSGVLFFLKQQSQFLCLAVQEGSLVLLYDFGAGLKKAVPLQPPPPLTSASKAIQVF

LLGGSRKRVLVRVERATVYSVEQDNDLELADAYYLGGVPPDQLPSLRRLFPTGGSVRGCVKGIK

ALGKYVDLKRLNTTGVSAGCTADLLVGRANTFHGHGFLRLALSNVAPLTGNVYSGFGFHSAQDS

ALLYYRASPVRPHQVSLQQGRVSLQLLRTEVKTQAGFADCAPHYVAFYSNATGVWLYVDDQLQQ

MKPHRGPPPELQPQPEGPPRLLLGGLPESGTIYNFSGCISNVFVQRLLGPQRVFDLQQNLGSVN

VSTGCAPALQAQTPGLGPRQASRRSRQPARHPACMLPPHLRTTRDSYQFGGSLSSHLEFVGILA

RHRNVSVRWEKNRILLVTDGARAWSQEGPHRQHQGABHFQPHTLFVGGLFASSHSSKLPVTVGF

SGCVKRLRLNGRPLGAPTRMAGVTPCILGPLEAGLFFPGSGGVITLCLPGATLPDVGLELEVRP

LAVTGLIFHLGQARTPPYLQLQVLPRQVLLRADDGAGEFSTSVTRPSVLCDGQWHRLAVMKSGN

VLRLEVDAQSNHTVGPLLAAAAGAPAPLYLGGLPEPMAVQPWPPAYCGCMRRLAVNRSPVAMTR

SVEVHGAVGASGCPAA

A search of sequence databases reveals that the NOV1a amino acid sequence has 2566 of 3652 amino acid residues (70%) identical to, and 2823 of 3652 amino acid residues (77%) similar to, the 3652 amino acid residue ptnr:ntrr: SWISSNEW-ACC:T10053 laminin alpha 5 chain from mouse (E=0.0). Public amino acid databases include the GenBank databases, SwissProt, PDB and PIR.

NOV1a is expressed in at least the following tissues: brain, Prostate, ovary, kidney, melanocyte+heart+uterus, breast, head and neck, stomach, genitourinary tract, pancreas, lung+testis+b-cell, dorsal root ganglia. This information was derived by determining the tissue sources of the sequences that were included in the invention including but not limited to SeqCalling sources, Public EST sources, Literature sources, and/or RACE sources.

NOV1b

A disclosed NOV1b nucleic acid of 3126 nucleotides (also referred to as CG102167-01) encoding a novel human laminin alpha 5-like protein is shown in Table 1C. An open reading frame was identified beginning with an ATG initiation codon at nucleotides 121–123 and ending with a TGA termination codon at nucleotides 2845–2847. The start and stop codons are in bold letters in Table 1C, and the 5' and 3' untranslated regions are underlined.

TABLE 1C

NOV1b nucleotide sequence (SEQ ID NO:3).

TCAGGGGTGCAGCTGCGCACCCCACGGGATCTTQCCGACCTTGCTGCCTACACTGCCCTCAAGTTCTACCTG

CAGGGCCCAGAGCCTGAGCCTGGGCAGGGTACCGAGGATCGCTTTGTATGTACATGGGCAGCCGCCAGGCC

ACTGGGGACTACATGGGTGTGTCTCTGCGTGACAAGAAGGTGCACTGGGTGTATCAGCTGGGTGAGGCGGGC

CCTGCAGTCCTAAGCATCGATGAGGACATTGGGGAGCAGTTCGCAGCTGTCAGCCTGGACAGGACTCTCCAG

TTTGGCCACATGTCCGTCACAGTGGAGAGACAGATGATCCAGGAAACCAAGGGTGACACGGTGGCCCCTGGG

GCAGACGGGCTGCTCAACCTGCGGCCAGACGACTTCGTCTTCTACGTCGGGGGGTACCCCAGTACCTTCACG

CCCCCTCCCCTGCTTCGCTTCCCCGGCTACCGGGGCTGCATCGAGATGGACACGCTGAATGAGGAGGTGGTC

AGCCTCTACAACTTCGAGAGGACCTTCCAGCTGGACACGGCTGTGGACAGGCCTTGTGCCCGCTCCAAGTCG

ACCGGGGACCCGTGGCTCACGGACGGCTCCTACCTGGACGGCACCGGCTTCGCCCGCATCAGCTTCGACAGT

CAGATCAGCACCACCAAGCGCTTCGAGCAGGACCTGCGGCTCGTGTCCTACAGCGGCGTGCTCTTCTTCCTG

AAGCAGCAGAGCCAGTTCCTGTGCTTGGCCGTCCAAGAAGGCAGCCTCGTGCTGTTGTATGACTTTGGGGCT

GGCCTGAAAAAGGCCGTCCCACTGCAGCCCCCACCGCCCCTGACCTCGGCCAGCAAGGCGATCCAGGTGTTC

CTGCTGGGGGGCAGCCGCAAGCGTGTGCTGGTGCGTGTGGAGCGGGCCACGGTGTACAGCGTGGAGCAGGAC

AATGATCTGGAGCTGGCCGACGCCTACTACCTGGGGGGCGTGCCGCCCGACCAGCTGCCCCCGAGCCTGCGA

TGGCTCTTCCCCACCGGAGGCTCAGTCCGTGGCTGCGTCAAAGGCATCAAGGCCCTGGGCAAGTATGTGGAC

CTCAAGCGGCTGAACACGACAGGCGTGAGCGCCGGCTGCACCGCCGACCTGCTGGTGGGGCGCGCCATGACT

TTCCATGGCCACGGCTTCCTTCGCCTGGCGCTCTCGAACGTGGCACCGCTCACTGGCAACGTCTACTCCGGC

TTCGGCTTCCACAGCGCCCAGGACAGTGCCCTGCTCTACTACCGGGCGTCCCCGGATGGGCTATGCCAGGTG

TCCCTGCAGCAGGGCCGTGTGAGCCTACAGCTCCTGAGGACTGAAGTGAAAACTCAAGCGGGCTTCGCCGAT

GGTGCCCCCCATTACGTCGCCTTCTACAGCAATGCCACGGGAGTCTGGCTGTATGTCGATGACCAGCTCCAG

CAGATGAAGCCCCACCGGGGACCACCCCCCGAGCTCCAGCCGCAGCCTGAGGGGCCCCCGAGGCTCCTCCTG

GGAGGCCTGCCTGAGTCTGGCACCATTTACAACTTCAGTGGCTGCATCAGCAACGTCTTCGTGCAGCGGCTC

CTGGGCCCACAGCGCGTATTTGATCTGCAGCAGAACCTGGGCAGCGTCAATGTGAGCACGGGCTGTGCACCC

GCCCTGCAAGCCCAGACCCCGGGCCTGGGGCCTAGAGGACTGCAGGCCACCGCCCGGAAGGCCTCCCGCCGC

AGCCGTCAGCCCGCCCGGCATCCTGCCTGCATGCTGCCCCCACACCTCAGGACCACCCGAGACTCCTACCAG

TTTGGGGGTTCCCTGTCCAGTCACCTGGAGTTTGTGGGCATCCTGGCCCGACATAGGAACTGGCCCAGTCTC

TCCATGCACGTCCTCCCGCGAAGCTCCCGAGGCCTCCTCCTCTTCACTGCCCGTCTGAGGCCCGGCAGCCCC

TCCCTGGCGCTCTTCCTGAGCAATGGCCACTTCGTTGCACAGATGGAAGGCCTCGGGACTCGGCTCCGCGCC

CAGAGCCGCCAGCGCTCCCGGCCTGGCCGCTGGCACAAGGTCTCCGTGCGCTGGGAGAAGAACCGGATCCTG

CTGGTGACGGACGGGGCCCGGGCCTGGAGCCAGGAGGGGCGCACCGGCAGCACCAGGGGGCAGAGCACCCC

CAGCCCCACACCCTCTTTGTGGGCGGCCTCCCCGGCCAGCAGCCACAGCTCCAAACTTCCGGTGACCGTCGGG

TABLE 1C-continued

NOV1b nucleotide sequence (SEQ ID NO:3).

TTCAGCGGCTGTGTGAAGAGACTGAGGCTGCACGGGAGGCCCCTGGGGGCCCCCACACGGATGGCAGGGGTC

ACACCCTGCATCTTGGGCCCCCTGGAGGCGGGCCTGTTCTTCCCAGGCAGCGGGGGAGTTATCACTTTAGAC

CTCCCAGGAGCTACACTGCCTGATGTGGGCCTGGAACTGGAGGTGCGGCCCCTGGCAGTCACCGGACTGATC

TTCCACTTGGGCCAGGCCCGGACGCCCCCCTACTTGCAGTTGCAGGTCCTGCTGCGGGCGGATGACGGAGCA

GGGGAGTTCTCCACGTCAGTGACCCGCCCCTCAGTGCTGTGTGATGGCCAGTGGCACCGGCTAGCGGTGATG

AAAAGCGGGAATGTGCTCCGGCTGGAGGTGGACGCGCAGAGCAACCACACCGTGGGCCCCTTGCTGGCGGCT

GCAGCTGGTGCCCCAGCCCCTCTGTACCTCGGGGGCCTGCCTGAGCCCATGGCCGTGCAGCCCTGGCCCCCC

GCCTACTGCGGCTGCATGAGGAGGCTGGCGGTGAACCGGTCCCCCGTCGCCATGACTCGCTCTGTGGAGGTC

CACGGGCAGTGGGGGCCAGTGGCTGCCCAGCCGCCTAGGACACAGCCAACCCCGGCCCCTGGTCAGGCCCC

TGCAGCTGCCTCACACCGCCCCTTGTGCTCGCCTCATAGGTGTCTATTTGGACTCTAAGCTCTACGGGTGAC

AGATCTTGTTTCTGAAGATGGTTTAAGTTATAGCTTCTTAAACGAAAGAATAAAATACTGCAAAATGTTTTT

ATATTTGGCCCTTCCACCCATTTTTAATTGTGAGAGATTTGTCACCAATCATCACTGGTTCCTCCTTAAAAA

TTAAAAAGTAACTTCTGTGTAAAAAAAAAA

In a search of public sequence databases, the NOV1b nucleic acid sequence, located on chromsome 20 has 2495 of 2495 bases (100%) identical to a gb:GENBANK-ID:HSLAMA5|acc:Z95636.1 mRNA from *Homo sapiens* (*H. sapiens* mRNA for laminin alpha chain) (E=0.0). Public nucleotide databases include all GenBank databases and the GeneSeq patent database.

The disclosed NOV1b polypeptide (SEQ ID NO:4) encoded by SEQ ID NO:3 has 908 amino acid residues and is presented in Table 1B using the one-letter amino acid code. Signal P, Psort and/or Hydropathy results predict that NOV1b has no signal peptide and is likely to be localized the microbody (peroxisome) with a certainty of 0.5371. In other embodiments, NOV1b may also be localized to the lysosome (lumen) with acertainty of 0.3191, the mitochondrial matrix space with a certainty of 0.1000 or in the nucleus with a certainty of 0.1000.

TABLE 1D

Encoded NOV1b protein sequence (SEQ ID NO:4).

MYMGSRQATGDYMGVSLRDKKVHWVYQLGEAGPAVLSIDEDIGEQFAAVSLDRTLQFGHMSVTVERQMIQET

KGDTVAPGAEGLLNLRPDDFVFYVGGYPSTFTPPPLLRFPGYRGCIEMDTLNEEVVSLYNFERTFQLDTAVD

RPCARSKSTGDPWLTDGSYLDGTGFARISFDSQISTTKRFEQELRLVSYSGVLFFLKQQSQFLCLAVQEGSL

VLLYDFGAGLKKAVPLQPPPPLTSASKAIQVFLLGGSRKRVLVRVERATVYSVEQDNDLELADAYYLGGVPP

DQLPPSLRWLFPTGGSVRGCVKGIKALGKYVDLKRLNTTGVSAGCTADLLVGRAMTFHGHGFLRLALSNVAP

LTGNVYSGFGFHSAQDSALLYYRASPDGLCQVSLQQGRVSLQLLRTEVKTQAGFADGAPHYVAFYSNATGVW

LYVDDQLQQMKPHRGPPPELQPPQPEGPPRLLLGGLPESGTIYNFSGISNVFVQRLLGPQRVFDLQQNLGSV

NVSTGCAPALQAQTPGLGPRGLQATARKASRRSRQRARHPACMLPPHLRTTRDSYQFGGSLSSHLEFVGILA

RHRNWPSLSMHVLPRSSRGLLLFTARLRPGSPSLALFLSNGHFVAQMEGLGTRLRAQSRQRSRPGRWHKVSV

RWEKNRILLVTDGARAWSQEGPHRQHQGAEHPQPHTLFVGGLPASSHSSKLPVTVGFSGCVKRLRLHGRPLG

APTRMAGVTPCILGPLEAGLFFPGSGGVITLDLPGATLPDVGLELEVRPLAVTGLIFHLGQARTPPYLQLQV

LLRADDGAGEFSTSVTRPSVLCDGQWHRLAVMKSGNVLRLEVDAQSNHTVGPLLAAAAGAPAPLYLGGLPEP

MAVQPWPPAYCGCMRRLAVNRSPVAMTRSVEVHGAVGASGCPAA

A search of sequence databases reveals that the NOV1b amino acid sequence has 908 of 913 amino acid residues (99%) identical to, and 908 of 913 amino acid residues (99%) similar to, the 1645 amino acid residue ptnr:SWISSNEW-ACC:O15230 protein from *Homo sapiens* (Human) (Laminin Alpha-5 Chain) (E=0.0). Public amino acid databases include the GenBank databases, SwissProt, PDB and PIR.

NOV1b is expressed in at least the following tissues: brain, Prostate, ovary, kidney, melanocyte, heart, uterus, breast, head and neck, stomach, genitourinary tract, pancreas, lung, testis, b-cell, dorsal root ganglia. Expression information was derived from the tissue sources of the sequences that were included in the derivation of the sequence of CuraGen Acc. No. CG102167-01. The sequence is predicted to be expressed in placenta because of the expression pattern of (GENBANK-ID: gb:GENBANK-ID:HSLAMA5|acc:Z95636.1) a closely related *H. sapiens* mRNA for laminin alpha 5 chain.

NOV1c

A disclosed NOV1c nucleic acid of 10800 nucleotides (also referred to as CG55974-02) encoding a novel human laminin alpha 5-like protein is shown in Table 1E. An open reading frame was identified beginning with an ATG initiation codon at nucleotides 1–3 and ending with a TGA termination codon at nucleotides 10792–10794. The start and stop codons are in bold letters in Table 1E, and the 5' and 3' untranslated regions are underlined. Since the start codon of NOV1c is not a traditional initiation codon, and NOV1c has no termination codon, NOV1c could be a partial open reading frame that could be extended in the 5' and/or 3' direction(s).

TABLE 1E

NOV1c nucleotide sequence (SEQ ID NO:5).

ATGGCGAAGCGGCTCTGCGCGGGGAGCGCACTGTGTGTTCGCGGCCCCGGGGCCCCGCGCCGCTGCTGCTG

CACCCGCCCTACTTCAACCTGGCCGAGGGCGCCCGCATCGCCGCCTCCGCGACCTGCGGAGAGGAGGCCCCG

GCGCGCGGCTCCCCGCGCCCCACCGAGGACCTTTACTGCAAGCTGGTAGGGGGCCCCGTGGCCGGCGGCGAC

CCCAACCAGACCATCCAGGGCCAGTACTGTGACATCTGCACGGCTGCCAACAGCAACAAGGCACACCCCGCG

AGCAATGCCATCGATGGCACGGAGCGCTGGTGGCAGAGTCCACCGCTGTCCCGCGGCCTGGAGTACAACGAG

GTCAACGTCACCCTGGACCTGGGCCAGGTCTTCCACGTGGCCTACGTCCTCATCAAGTTTGCCAACTCACCC

CGGCCGGACCTCTGGGTGCTGGAGCGGTCCATGGACTTCGGCCGCACCTACCAGCCCTGGCAGTTCTTTGCC

GCCTCCAAGAGGGACTGTCTGGAGCGGTTCGGGCCACAGACGCTGGAGCGCATCACACGGGACGACGCGGCC

ATCTGCACCACCGAGTACTCACGCATCGTGCCCCTGGAGAACGGAGAGATCGTGGTGTCCCTGGTGAACGGA

CGTCCGGGCGCCATGAATTTCTCCTACTCGCCGCTGCTACGTGAGTTCACCAAGGCCACCAACGTCCGCCTG

CGCTTCCTGCGTACCAACACGCTGCTGGGCCATCTCATGGGGAAGGCGCTGCGGGACCCCACGGTCACCCGC

CGGTATTATTACAGCATCAAGGATATCAGCATCGGAGGCCGCTGTGTCTGCCACGGCCACGCGGATGCCTGC

GATGCCAAAGACCCCACGGACCCGTTCAGGCTGCAGTGCACCTGCCAGCACAACACCTGCGGGGGCACCTGC

GACCGCTGCTGCCCCGGCTTCAATCAGCAGCCGTGGAAGCCTGCGACTGCCAACAGTGCCAACGAGTGCCAG

TGTGAGTGCTACGGCCATGCCACCGACTGTTACTACGACCCTGAGGTGGACCGGCGCCGCGCCAGCCAGAGC

CTGGATGGCACCTATCAGGGTGGGGGTGTCTGTATCGACTGCCAGCACCACACCACCGGCGTCAACTGTGAG

CGCTGCCTGCCCGGCTTCTACCGCTCTCCCAACCACCCCTCTCGACTCGCCCCACGTCTGCCGCGGCTGCAAC

TGCGAGTCCGACTTCACGGATGGCACCTGCGAGGACCTGACGGGTCGATGCTACTGCCGGCCCAACTTCTCT

GGGGAGCGGTGTGACGTGTGTGCCGAGGGCTTCACGGGCTTCCCAAGCTGCTACCGTGAGCACCTGCCAGGG

AATGACACCAGGGAGCAGGTGCTGCCAGCCGGCCAGATTGTGAGTTGTGACTGCAGCGCGGCAGGGACCCAG

GGCAACGCCTGCCGGAAGGACCCAAGGGTGGGACGCTGTCTGTGCAAACCCAACTTCCAAGGCACCCATTGT

GAGCTCTGCGCGCCAGGGTTCTACGGCCCCGGCTGCCCTGCCAGTGTTCCAGCCCTGGAGTGGCCGATGACC

GCTGTGACCCTGACACAGGCCAGTGCAGGTGCCGAGTGGGCTTCGAGGGGGCCACATGTGATCGCTGTGCCC

CCGGCTACTTTCACTTCCCTCTCTGCCAGTCACCCGCTCCGCTCTGCAGTGTGTGGCTGCAGCCCTGCAGGA

ACCTTGCCCGAGGGCTGCGATGAGGCCGGCCGCTGCCTATGCCAGCCTGAGTTTGCTGGACCTCATTGTGAC

CGGTGCCGCCCTGGCTACCATGGTTTCCCCAACTGCGCAGCATGCACCTGCGACCCTCGGGGAGCCCTGGAC

CAGCTCTGTGGGGCGGGAGGTTTGTGCCGCTGCCGCCCCGGCTACACAGGCACTGCCTGCCAGGAATGCAGC

CCCGGCTTTCACGGCTTCCCCAGCTGTCCTGCCACTGCTCTGCTGAAGGCTCCCTGCACGCAGCCTGTGACC

CCCGGAGTGGGCAGTGCAGCTGCCGGCCCCGTGCGGGGCTGCGGTGTGACACGTGTGTGCCCGGTGCCTACA

ACTTCCCCTACTGCGAAGCTGGCTCTTGCCACCCTGCCGGTCTGGCCCCCAGTGGATCCTGCCCTTCCTGAG

TABLE 1E-continued

NOV1c nucleotide sequence (SEQ ID NO:5).

```
GCACAGGTTCCCTGTATGTGCCGGGCTCACGTGGAGGGGCCGAGCTGTGACCGCTGCAAACCTGGGTTCTGG
GGACTGAGCCCCAGCAACCCCGAAGGCTGTACCCGCTGCAGCTGCGACCTCAGGGGCACACTGGGTGGAGTT
GCTGAGTGCCAGCCGGGCACCGGCCAGTGCTTCTGCAAGCCCCACGTGTGCGGCCAGGCCTGCGCGTCCTGC
AAGGATGGCTTCTTTGGACTGGATCAGGCTGACTATTTTGGCTGCCGCAGCTGCCGGTGTGACATTGGCGGT
GCACTGGGCCAGAGCTGTGAACCGAGGACGGGCGTCTGCCGGTGCCGCCCCAACACCCAGGGCCCCACCTGC
AGCGAGCCTGCGAGGGACCACTACCTCCCGGACCTGCACCACCTGCGCCTGGAGCTGGAGGAGGCTGCCACA
CCTGAGGGTCACGCCGTGCGCTTTGGCTTCAACCCCCTCGAGTTCGAGAACTTCAGCTGGAGGGGCTACGCG
CAGATGGCACCTGTCCAGCCCAGGATCGTGGCCAGGCTGAACCTGACCTCCCCCGACCTTTTCTGGCTCGTC
TTCCGATACGTCAACCGGGGGGCCATGAGTGTGAGCGGGCGGGTCTCTGTGCGAGAGGAGGGCAGGTCGGCC
GCCTGTGCCAACTGCACAGCACAGAGTCAGCCCGTGGCCTTCCCACCCAGCACGGAGCCTGCCTTCATCACC
GTGCCCCAGAGGGGCTTCGGAGAGCCCTTTGTGCTGAACCCTGGCACCTGGGCCCTGCGTGTGGAGGCCGAA
GGGGTGCTCCTGGACTACGTGGTTCTGCTGCCTAGCGCATACTACGAGGCGGCGCTCCTGCAGCTGCGGGTG
ACTGAGGCCTGCACATACCGTCCCTCTGCCCAGCAGTCTCCCCCCAGCTGCCTCCTCTACACACACCTCCCC
CTGGATGGCTTCCCCTCGGCCGCCGGGCTGGAGGCCCTGTGTCGCCAGGACAACAGCCTGCCCCGGCCCTGC
CCCACGGAGCAGCTCAGCCCGTCGCACCCGCCACTGATCACCTGCACGGGCAGTGATGTGGACGTCCAGCTT
CAAGTGGCAGTGCCACAGCCAGGCCGCTATGCCCTAGTGGTGGAGTACGCCAATGAGGATGCCCGCCAGGAG
GTGGGCGTGGCCGTGCACACCCCACAGCGGGCCCCCCAGCAGGGGCTGCTCTCCCTGCACCCCTGCCTGTAC
AGCACCCTGTGCCGGGGCACTGCCCGGGATACCCAGGACCACCTGGCTGTCTTCCACCTGGACTCGGAGGCC
AGCGTGAGGCTCACAGCCGAACAGGCACGCTTCTTCCTGCACGGGGTCACTCTGGTGCCCATTGAGGAGTTC
AGCCCGGAGTTCGTGGAGCCCCGGGTCAGCTGCATCAGCAGCCACGGCGCCTTTGGCCCCAACAGTGCCGCC
TGTCTGCCCTCGCGCTTCCCAAAGCCGCCCCAGCCCATCATCCTCAGGGACTGCCAGGTGATCCCGCTGCCG
CCCGGCCTCCCGCTGACCCACGCGCAGGATCTCACTCCAGCCATGTCCCAGCTGGACCCCGACCTCGGCCC
CCCACCGCTGTGGACCCTGATGCAGAGCCCACCCTGCTGCGTGAGCCCCAGGCCACCGTGGTCTTCACCACC
CATGTGCCCACGCTGGGCCGCTATGCCTTCCTGCTGCACGGCTACCAGCCAGCCCACCCCACCTTCCCCGTG
GAAGTCCTCATCAACGCCGGCCGCGTGTGGCAGGGTCACGCCAACGCCAGCTTCTGTCCACATGGCTACGGC
TGCCGCACCCTGGTGGTGTGTGAGGGCCAGGCCCTGCTGGACGTGACCCACAGCGAGCTCACTGTGACCGTG
CGTGTGCCCAAGGGCCGGTGGCTCTGGCTGGATTATGTACTCGTGGTCCCTGAGAACGTCTACAGCTTTGGC
TACCTCCGGGAGGAGCCCCTGGATAAATCCTATGACTTCATCAGCCACTGCGCAGCCCAGGGCTACCACATC
AGCCCCAGCAGCTCATCCCTGTTCTGCCGAAACGCTGCTGCTTCCCTCTCCCTCTTCTATAACAACGGAGCC
CGTCCATGTGGCTGCCACGAAGTAGGTGCTACAGGCCCCACGTGTGAGCCCTTCGGGGCCAGTGTCCCTGC
CATGCCCATGTCATTGGCCGTGACTGCTCCCGCTGTGCCACCGGATACTGGGCTTCCCCAACTGCAGGGCC
TGTGACTGCGGTGCCCGCCTCTGTGACGAGCTCACGGGCCAGTGCATCTGCCCGCCACGCACCATCCCGCCC
GACTGCCTGCTGTGCCAGCCCCAGACCTTTTGCTGCCACCCCCTGGTCGGCTGTGAGGAGTGTAACTGCTCA
GGGCCCGGCATCCAGGAGCTCACAGACCCTACCTGTGACACAGACAGCGGCCAGTGCAGGTGCAGACCCAAC
GTGACTGGGCGCCGCTGTGATACCTGCTCTCCGGGCTTCCATGGCTACCCCGCTGCCGCCCCTGTGACTGT
CACGAGGCGGGCACTGCGCCTGGCGTGTGTGACCCCCTCACAGGGCAGTGCTACTGTAAGGAGAACGTGCAG
GGCCCCAAATGTGACCAGTGCAGCCTTGGGACCTTCTCACTGGATGCTGCCAACCCCAAAGGTTGCACCCGC
TGCTTCTGCTTTGGGGCCACGGAGCGCTGCCGGAGCTCGTCCTACACCCGCCAGGAGTTCGTGGATATGGAG
```

TABLE 1E-continued

NOV1c nucleotide sequence (SEQ ID NO:5).

```
GGATGGGTGCTGCTGAGCACTGACCGGCAGGTGGTGCCCCACGAGCGGCAGCCAGGGACGGAGATGCTCCGT
GCAGACCTGCGGCACGTGCCTGAGGCTGTGCCCGAGGCTTTCCCCGAGCTGTACTGGCAGGCCCCACCCTCC
TACCTGGGGGACCGGGTAAGCTCCTACGGTGGGACCCTCCGTTATGAACTGCACTCAGAGACCCAGCGGGGA
GATGTCTTTGTCCCCATGGAGAGCAGGCCGGATGTGGTGCTGCAGGGCAACCAGATGAGCATCACATTCCTG
GAGCCGGCATACCCCACGCCTGGCCACGTTCACCGTGGGCAGCTGCAGCTGGTGGAGGGGAACTTCCGGCAT
ACGGAGACGCGCAACACTGTGTCCCGCGAGGAGCTCATGATGGTGCTGGCCAGCCTGGAGCAGCTGCAGATC
CGTGCCCTCTTCTCACAGATCTCCTCGGCTGTCTTCCTGCGCAGGGTGGCACTGGAGGTGGCCAGCCCAGCA
GGCCAGGGGGCCCTGGCCAGCAATGTGGAGCTGTGCCTGTGCCCCGCCAGCTACCGGGGGGACTCATGCCAG
GAATGTGCCCCCGGCTTCTATCGGACGTCAAAGGTCTCTTCCTGGGCCGATGTGTCCCTTGTCAGTGCCAT
GGACACTCAGACCGCTGCCTCCCTGGCTCTGGCGTCTGTGTGTGCCAGCACAACACCGAAGGGGCCCACTGT
GAGCGCTGCCAGGCTGGCTTCGTGAGCAGCAGGGACGACCCCAGCGCCCCTGTGTCAGCTGCCCCTGCCCC
CTCTCAGTGCCTTCCAACAGGTGTGCGCCCGGATTCTTTGGGAACCCACTGGTGCTGGGCAGCTCCTGCCAG
CCATGCGACTGCAGCGGCAACGGTGACCCCAACTTGCTCTTCAGCGACTGCGACCCCCTGACGGGCGCCTGC
CGTGGCTGCCTGCGCCACACCACTGGGCCCCGCTGCGAGATCTGTGCCCCCGGCTTCTACGGCAACGCCCTG
CTGCCCGGCAACTGCACCCGTTGCGACTGTACCCCATGTGGGACAGAGGCCTGCGACCCCCACAGCGGGCAC
TGCCTGTGCAAGGCGGGCGTGACTGGGCGGCGCTGTGACCGCTGCCAGGAGGGACATTTTGGTTTCGATGGC
TGCGGGGGCTGCCGCCCGTGTGCTTGTGGACCGGCCGCCGAGGGCTCCGAGTGCCACCCCCAGAGCGGACAG
TGCCACTGCCGACCAGGGACCATGGGACCCCAGTGCCGCGAGTGTGCCCCTGGCTACTGGGGGCTCCCTGAG
CAGGGCTGCAGGCGTTGCCAGTGCCCTGGGGGCCGCTGTGACCCTCACACGGGCCGCTGCAACTGCCCCCCG
GGGCTCAGCGGGGAGCGCTGCGACACCTGCAGCCAGCAGCATCAGGTGCCTGTTCCAGGCGGGCCTGTGGGC
CACAGCATCCACTGTGAAGTGTGTGACCACTGTGTGGTCCTGCTCCTGGATGACCTGGAACGGGCCGGCGCC
CTCCTCCCCGCCATTCACGAGCAACTGCGTGGCATCAATGCCAGCTCCATGGCCTGGGCCCGTCTGCACAGG
CTGAACGCCTCCATCGCTGACCTGCAGGTACTGAGCGTCCTGGCCTTCCCTCCCCAACCCGGGCCAGTGCAG
GCCTTCACCTTTCGCCTCCCACAGAGCCAGCTCCGGAGCCCCTGGGCCCCCGCCATGAGACGGCACAGCAG
CTGGAGGTGCTGGAGCAGCAGAGCACAAGCCTTCCTCCACAGGCCGTGGGGACCCGAGACCAGGCGAGCCAA
TTGCTGGCCGGCACCGAGGCCACACTGGGCCATGCGAAGACGCTGTTGGCGGCCATCCGGGCTGTGGACCGC
ACCCTGAGCGAGCTCATGTCCCAGACGGGCCACCTGGGGCTGGCCAATGCCTCGGCTCCATCAGGTGAGCAG
CTGCTCCGGACACTGGCCGAGGTGGAGCGGCTGCTCTGGGAGATGCGGGCCCGGGACCTGGGGGCCCCGCAG
GCAGCAGCTGAGGCTGAGTTGGCTGCAGCACAGAGAGTGCTGGCCCGGGTGCAGGAGCAGCTGAGCAGCCTC
TGGGAGGAGAACCAGGCACTGGCCACACAAACCCGCGACCGGCTGGCCCAGCACGAGGCCGGCCTCATGGAC
CTGCGAGAGGCTTTGAACCGGGCAGTGGACGCCACACGGGAGGCCCAGGAGCTCAACAGCCGCAACCAGGAG
CGCCTGGAGGAAGCCCTGCAAAGGAAGCAGGAGCTGTCCCGGGACAATGCCACCCTGCAGGCCACTCTGCAT
GCGGCTAGGGACACCCTGGCCAGCGTCTTCAGATTGCTGGAGGGGCTAAGTCCACTCAAATTCCAGGAGCTG
GAGCGCCTCGCCGCCAGCCTGGATGGGGCTCGGACCCCACTGCTGCAGAGGATGCAGACCTTCTCCCCGGCG
GGCAGCAAGCTGCGTCTAGTGGAGGCCGCCGAGGCCCACGCACAGCAGCTGGGCCAGCTGGCACTCAATCTG
TCCATCATCCTGGACGTCAACCAGGACCGCCTCACCCAGAGGGCCATCGAGGCCTCCAACGCCTACAGCCGC
ATCCTGCAGGCCGTGCAGGCTGCCGAGGATGCTGCTGGCCAGGCCCTGCAGCAGGCGGACCACACGTGGCAG
ACGGTGGTGCGGCAGGGCCTGGTGGACCGAGCCCAGCAGCTCCTGGCCAACAGCACTGCACTAGAAGAGGCC
ATGCTCCAGGAACAGCAGAGGCTGGGCCTTGGTGAGTGCTGGGCTCCGATGGGGCCCCTTAGGCCTGCTGGG
```

TABLE 1E-continued

NOV1c nucleotide sequence (SEQ ID NO:5).

ACCCAGCTCCGAGATGTCCGGGCCAAGAAGGACCAGCTGGAGGCGCACATCCAGGCGGCGCAGGCCATGCTT
GCCATGGACACAGGTGAGACAAGCAAGAAGATCGCACATGCCAAGGCTGTGGCTGCTGAAGCCCAGGACACC
GCCACCCGTGTGCAGTCCCAGCTGCAGGCCATGCAGGAGAATGTGGAGCGGTGGCAGGGCCAGTACGAGGGC
CTGCGGGGCCAGGACCTGGGCCAGGCAGTGCTTGACGCAGGCTCTGCAGTGTCCACCCTGGAGAAGACGCTG
CCCCAGCTGCTGGCCAAGCTGAGCATCCTGGAGAACCGTGGGGTGCACAACGCCAGCCTGGCCCTGTCCGCC
AGCATTGGCCGCGTGCGAGAGCTCATTGCCCAGGCCCGGGGGCTGCCAGTAAGGTGGTCAAGGTGCCCATG
AAGTTCAACGGGCGCTCAGGGGTGCAGCTGCGCACCCCACGGGATCTTGCCGACCTTGCTGCCTACACTGCC
CTCAAGTTCTACCTGCAGGGCCCAGAGCCTGAGCCTGGGCAGGGTACCGAGGATCGCTTTGTGATGTACATG
GGCAGCCGCCAGGCCACTGGGGACTACATGGGTGTGTCTCTGCGTGACAAGAAGGTGCACTGGGTGTATCAG
CTGGGTGAGGCGGGCCCTGCAGTCCTAAGCATCGATGAGGACATTGGGGAGCAGTTCGCAGCTGTCAGCCTG
GACAGGACTCTCCAGTTTGGCCACATGTCCGTCACAGTGGAGAGACAGATGATCCAGGAAACCAAGGGTGAC
ACGGTGGCCCCTGGGGCAGAGGGGCTGCTCAACCTGCGGCCAGACGACTTCGTCTTCTACGTCGGGGGGTAC
CCCAGTACCTTCACGCCCCCTCCCCTGCTTCGCTTCCCCGGCTACCGGGGCTGCATCGAGATGGACACGCTG
AATGAGGAGGTGGTCAGCCTCTACAACTTCGAGAGGACCTTCCAGCTGGACACGGCTGTGGACAGGCCTTGT
GCCCGGTCCAAGTCGACCGGGGACCCGTGGCTCACGGACGGCTCCTACCTGGACGGCACCGGCTTCGCCCGC
ATCAGCTTCGACAGTCAGATCAGCACCACCAAGCGCTTCGAGCAGGAGCTGCGGCTCGTGTCCTACAGCGGG
GTGCTCTTCTTCCTGAAGCAGCAGAGCCAGTTCCTGTGCTTGGCCGTGCAAGAAGGCAGCCTCGTGCTGTTG
TATGACTTTGGGGCTGGCCTGAAAAAGGCCGTCCCACTGCAGCCCCCACCGCCCCTGACCTCGGCCAGCAAG
GCGATCCAGGTGTTCCTGCTGGGGGGCAGCCGCAAGCGTGTGCTGGTGCGTGTGGAGCGGGCCACGGTGTAC
AGCGTGGAGCAGGACAATGATCTGGAGCTGGCCGACGCCTACTACCTGGGGGGCGTGCCGCCCGACCAGCTG
CCCAGCCTGCGACGGCTCTTCCCCACCGGAGGCTCAGTCCGTGGCTGCGTCAAAGGCATCAAGGCCCTGGGC
AAGTATGTGGACCTCAAGCGGCTGAACACGACAGGCGTGAGCGCCGGCTGCACCGCCGACCTGCTGGTGGGG
CGCGCCATGACTTTCCATGGCCACGGCTTCCTTCGCCTGGCGCTCTCGAACGTGGCACCGCTCACTGGCAAC
GTCTACTCCGGCTTCGGCTTCCACAGCGCCCAGGACAGTGCCCTGCTCTACTACCGGGCGTCCCCGGTGAGA
CCTCACCAGGTGTCCCTGCAGCAGGGCCGTGTGAGCCTACAGCTCCTGAGGACTGAAGTGAAAACTCAAGCG
GGCTTCGCCGATGGTGCCCCCCATTACGTCGCCTTCTACAGCAATGCCACGGGGTCTGGCTGTATGTCGAT
GACCAGCTCCAGCAGATGAAGCCCCACCGGGGACCACCCCCCGAGCTCCAGCCGCAGCCTGAGGGGCCCCCG
AGGCTCCTCCTGGGAGGCCTGCCTGAGTCTGGCACCATTTACAACTTCAGTGGCTGCATCAGCAACGTCTTC
GTGCAGCGGCTCCTGGGCCCACAGCGCGTATTTGATCTGCAGCAGAACCTGGGCAGCGTCAATGTGAGCACG
GGCTGTGCACCCGCCCTGCAAGCCCAGACCCCGGGCCTGGGGCCTAGACAGGCCTCCCGCCGCAGCCGTCAG
CCCGCCCGGCATCCTGCCTGCATGCTGCCCCCACACCTCAGGACCACCCGAGACTCCTACCAGTTTGGGGGT
TCCCTGTCCAGTCACCTGGAGTTTGTGGGCATCCTGGCCCGACATAGGAACGTCTCCGTGCGCTGGGAGAAG
AACCGGATCCTGCTGGTGACGGACGGGGCCCGGGCCTGGAGCCAGGAGGGGCCGCACCGGCACCACCAGGGG
GCAGAGCACCCCCAGCCCCACACCCTCTTTGTGGGCGGCCTCCCGGCCAGCAGCCACAGCTCCAAACTTCCG
GTGACCGTCGGGTTCAGCGGCTGTGTGAAGAGACTGAGGCTGCACGGGAGGCCCCTGGGGGCCCCCACACGG
ATGGCAGGGGTCACACCCTGCATCTTGGGCCCCCTGGAGGCGGGCCTGTTCTTCCCAGGCAGCGGGGAGTT
ATCACTTTAGGTCTGCCAGGAGCTACACTGCCTGATGTGGGCCTGGAACTGGAGGTGCGGCCCCTGGCAGTC
ACCGGACTGATCTTCCACTTGGGCCAGGCCCGGACGCCCCCCTACTTGCAGTTGCAGGTGCTACCCCGCCAG

TABLE 1E-continued

NOV1c nucleotide sequence (SEQ ID NO:5).

GTCCTGCTGCGGGCGGATGACGGAGCAGGGGAGTTCTCCACGTCAGTGACCCGCCCCTCAGTGCTGTGTGAT

GGCCAGTGGCACCGGCTAGCGGTGATGAAAAGCGGGAATGTGCTCCGGCTGCAGGTGGACGCGCAGAGCAAC

CACACCGTGGGCCCCTTGCTGGCGGCTGCAGCTGGTGCCCCAGCCCCTCTGTACCTCGGGGGCCTGCCTGAG

CCCATGGCCGTGCAGCCCTGGCCCCCCGCCTACTGCGGCTGCATGAGGAGGCTGGCGGTGAACCGGTCCCCC

GTCGCCATGACTCGCTCTGTGGAGGTCCACGGGCAGTGGGGGCCAGTGGCTGCCCAGCCGCCTAG<u>AATAAA</u>

In a search of public sequence databases, the NOV1c nucleic acid sequence, located on chromsome 20 has 3800 of 4840 bases (78%) identical to a gb:GENBANK-ID:MMU37501 acc:U37501.1 mRNA from *Mus musculus* (*Mus musculus* laminin alpha 5 chain (Lama5) mRNA, partial cds) (E=0.0). Public nucleotide databases include all GenBank databases and the GeneSeq patent database.

The disclosed NOV1c polypeptide (SEQ ID NO:6) encoded by SEQ ID NO:5 has 3597 amino acid residues and is presented in Table 1F using the one-letter amino acid code. Signal P, Psort and/or Hydropathy results predict that NOV1c has a signal peptide and is likely to be localized the mitochondrial matrix space with a certainty of 0.4318. In other embodiments, NOV1c may also be localized to the microbody (peroxisome) with acertainty of 0.3000, the lysosome (lumen) with a certainty of 0.2055 or in the mitochondrial inner membrane with a certainty of 0.1122. The most likely cleavage site for NOV1c is between positions 14 and 15: CVR-GP

TABLE 1F

Encoded NOV1c protein sequence (SEQ ID NO:6).

MAKRLCAGSALCVRGPRGPAPLLLHPPYFNLAEGARIAASATCGEEAPARGSPRPTEDLYCKLVGGPVAGGD

PNQTIQGQYCDICTAANSNKAHPASNAIDGTERWWQSPPLSRGLEYNEVNVTLDLGQVFHVAYVLIKFANSP

RPDLWVLERSMDFGRTYQPWQFFAASKRDCLERFGPQTLERITRDDAAICTTEYSRIVPLENGEIVVSLVNG

RPGAMNFSYSPLLREFTKATNVRLRFLRTNTLLGHLMGKALRDPTVTRRYYYSIKDISIGGRCVCHGHADAC

DAKDPTDPFRLQCTCQHNTCGGTCDRCCPGFNQQPWKPATANSANECQCECYGHATDCYYDPEVDRRRASQS

LDGTYQGGGVCIDCQHHTTGVNCERCLPGFYRSPNHPLDSPHVCRGCNCESDFTDGTCEDLTGRCYCRPNFS

GERCDVCAEGFTGFPSCYREHLPGNDTREQVLPAGQIVSCDCSAAGTQGNACRKDPRVGRCLCKPNFQGTHC

ELCAPGFYGPGCPASVPALEWPMTAVTLTQASAGAEWASRGPHVIAVPPATFTSLSASHPLRSAVCGCSPAG

TLPEGCDEAGRCLCQPEFAGPHCDRCRPGYHGFPNCAACTCDPRGALDQLCGAGGLCRCRPGYTGTACQECS

PGFHGFPSCPATALLKAPCTQPVTPGVGSAAAGPVRGCGVTRVCPVPTTSPTAKLALATLPVWPPVDPALPE

AQVPCMCRAHVEGPSCDRCKPGFWGLSPSNPEGCTRCSCDLRGTLGGVAECQPGTGQCFCKPHVCGQACASC

KDGFFGLDQADYFGCRSCRCDIGGALGQSCEPRTGVCRCRPNTQGPTCSEPARDHYLPDLHHLRLELEEAAT

PEGHAVRFGFNPLEFENFSWRGYAQMAPVQPRIVARLNLTSPDLFWLVFRYVNRGAMSVSGRVSVREEGRSA

ACANCTAQSQPVAFPPSTEPAFITVPQRGFGEPFVLVPGTWALRVEAEGVLLDYVVLLPSAYYEAALLQLRV

TEACTYRPSAQQSPPSCLLYTHLPLDGFPSAAGLEALCRQDNSLPRPCPTEQLSPSHPPLITCTGSDVDVQL

QVAVPQPGRYALVVEYANEDARQEVGVAVHTPQRAPQQGLLSLHPCLYSTLCRGTARDTQDHLAVFHLDSEA

SVRLTAEQARFFLHGVTLVPIEEFSPEPVEPRVSCISSHGAFGPNSAACLPSRFPKPPQPIILRDCQVIPLP

PGLPLTHAQDLTPAMSPAGPRPRPPTAVDPDAEPTLLREPQATVVFTTHVPTLGRYAFLLHGYQPAHPTFPV

EVLINAGRVWQGHANASFCPHGYGCRTLVVCEGQALLDVTHSELTVTVRVPKGRWLWLDYVLVVPENVYSFG

YLREEPLDKSYDFISHCAAQGYHISPSSSSLFCRNAAASLSLFYNNGARPCGCHEVGATGPTCEPFGGQCPC

HAHVIGRDCSRCATGYWGFPNCRACDCGARLCDELTGQCICPPRTIPPDCLLCQPQTFGCHPLVGCEECNCS

GPGIQELTDPTCDTDSGQCRCRPNVTGRRCDTCSPGPHGYPRCRPCDCHEAGTAPGVCDPLTGQCYCKENVQ

GPKCDQCSLGTFSLDAANPKGCTRCFCFGATERCRSSSYTRQEFVDMEGWVLLSTDRQVVPMERQPGTENLR

TABLE 1F-continued

Encoded NOV1c protein sequence (SEQ ID NO:6).

ADLRHVPEAVPEAFPELYWQAPPSYLGDRVSSYGGTLRYELHSETQRGDVFVPMESRPDVVLQGNQMSITFL

EPAYPTPGHVHRGQLQLVEGNFRHTETRBTVSREELMMVLASLEQLQIRALFSQISSAVFLRRVALEVASPA

GQGALASNVELCLCPASYRGDSCQECAPGFYRDVKCLFLGRCVPCQCH&USDRCLPGSGVCVCQHNTEGAHC

ERCQAGFVSSRDDPSAPCVSCPCPLSVPSNRCAPGFFGNPLVLGSSCQPCDCSGNGDPNLLFSDCDPLTGAC

RGCLRHTTGPRCEICAPGFYGNALLPGNCTRCDCTPCGTEACDPHSGHCLCKAGVTGRRCDRCQEGHFGFDG

CGGCRPCACGPAAEGSECHPQS&QCHCRPGTMGPQCRECAPGYWGLPEQGCRRCQCPGGRCDPHTGRCNCPP

GLSGERCDTCSQQHQVPVPGGPVGHSIRCEVCDHCVVLLLDDLERAGALLPAIHEQLRGINASSMAWARLHR

LNASIADLQVLSVLAFPPQPGPVQAFTSRLPQSQLRSPLGPRHETAQQLEVLEQQSTSLPPQAVCTRDQASQ

LLAGTEATLGHAKTLLAAIRAVDRTLSELMSQTGHLGLANASAPSGEQLLRTLAEVERLLWEMRARDLGAPQ

AAAEAELAAAQRVLARVQEQLSSLWEENQALATQTRDRLAQHEACLMDLREALNPAVDATREAQELNSRNQE

RLEEALQRKQELSRDNATLQATLHAARDTLASVFRLLEGLSPLKFQELERLAASLDCARTPLLQRMQTFSPA

GSKLRLVEAAEAHAQQLGQLALNLSIILDVNQDRLTQRAIEASNAYSRILQAVQAAEDAAGQALQQADHTWQ

TVVRQGLVDRAQQLLANSTALEEAMLQEQQRLGLGECWAPMGALRPAGTQLRDVRAKKDQLEAHIQAAQAML

AMDTGETSKIUARAKAVAAEAQDTATRVQSQLQAMQENVERWQGQYEGLRGQDLGQAVLDAGSAVSTLEKTL

PQLLAKLSILENRGVHNASLALSASIGRVRELIAQARGAASKVVKVPMKFNGRSGVQLRTFRDLADLAAYTA

LKFYLQGPEPEPGQGTEDRFVMYMGSRQATGDYNGVSLRDKKVHWVYQLGFAGPAVLSIDEDIGEQFAAVSL

DRTLQFGHMSVTVERQMIQETKGDTVAPGAECLLNIRPDDFVFYVGGYPSTFTPPPLLRFPGYRGCIEMDTL

NEEVVSLYNPERTFQLDTAVDRPCARSKSTGDPWLTDGSYLDGTGFARISFDSQISTTKRFEQELRLVSYSG

VLFFLKQQSQFLCLAVQEGSLVLLYDFGAGLKKAVPLQPPPPLTSASKATQVFLLGGSRKRVLVRVERATVY

SVEQDNDLELADAYYLGGVPPDQLPSLRRLFPTGGSVRGCVKGIKALGKYVDLKRLNTTGVSAGCTADLLVG

RAMTFHGHGFLRLALSNVAPLTGNVYSGFGFHSAQDSALLYYRASPVRPHQVSLQQGRVSLQLLRTEVKTQA

QFADGAPHYVAFYSNATGVWLYVDDQLQQMKPHRGPPPELQPQPEGPPRLLLGGLPESGTTYNFSGCISNVF

VQRLLGPQRVFDLQQNLGSVNVSTGCAPALQAQTPGLGPRQASRRSRQPARHPACMLPPHLRTTRDSYQFGG

SLSSHLEFVGILARHRNVSVRWEKNRILLVTDGARANSQEGPHRQHQGAEEPQPHTLFVGGLPASSHSSKLP

VTVGFSGCVKRLRLHGRPLGAPTRMAGVTPCILCPLEAGLFFPQSGGVITLQLPQATLPDVGLELEVRPLAV

TGLIFHLGQARTPPYLQLQVLPRQVLLRADDGAGEFSTSVTRPSVLCDCQWHRLAVMKSCNVLRLEVDAQSN

HTVGPLLAAAAGAPAPLYLGGLPEPMAVQPWFPAYCGCMRRLAVNRSPVAMTRSVEVHCAVGASGCPAA

NOV1c is expressed in at least the following tissues: Mammalian Tissue, Small Intestine, Bone Marrow, brain, Prostate, ovary, kidney, melanocyte, heart, uterus, breast, head and neck, stomach, genitourinary tract, pancreas, lung, testis, b-cell, dorsal root ganglia.

Expression information was derived from the tissue sources of the sequences that were included in the derivation of the sequence of CuraGen Acc. No. CG55974-02.

NOV1d

A disclosed NOV1d nucleic acid of 5204 nucleotides (also referred to as 164875783) encoding a novel Human laminin alpha 5-like protein is shown in Table 1G. An open reading frame was identified beginning with an TGT codon at nucleotides 3–5 and ending with a TAG codon at nucleotides 4923–4925. The start and stop codons are in bold letters and the 5' and 3' untranslated regions are underlined in Table 1G. Because the start codon is not a traditional initiation codon, NOV1d could be a partial reading frame. NOV1d could extend further in the 5' direction.

TABLE 1G

NOV1d nucleotide sequence (SEQ ID NO:7).

<u>GC</u>TGTGACCGCTGCCAGGAGCGACATTTTGGTTTCAATGGCTGCGGGGGCTGCCGCCCGTGTGCTTGTGGAC

CGGCCGCCGAGGGCTCCGAGTGCCACCCCCAGAGCGAACAGTGCCACTGCCGACCAGGGACCATGGGACCCC

AGTGCCGCGAGTGTGCCCCTCGCTACTCGGGGCTCCCTGAGCAGGGCTGCAGGCGCTGCCAGTGCCCTGCGG

GCCGCTGTGACCCTCACACGGGCCGCIGCAACTGCCCCCCGGGGCTCAGCGGGGAGCGCTGCGACACCTGCA

GCCAGCAGCATCAGGTGCCTGTTCCAGGCGGGCCTGTGGGCCACAGCATCCACTGTGAAGTGTGTGACCACT

GTGTGGTCCTGCTCCTGGATGACCTGGAACCGGCCGGCGCCCTCCTCCCCGCCATTCACGAGCAACTGCGTG

GCATCAATGCCAGCTCCATGGCCTGGGCCCGTCTGCACAGGCTGAACGCCTCCATCGCTGACCTGCAGAGCC

AGCTCCGGAGCCCCCTGQGCCCCCCCCATGAGACGGCACAGCAGCTGGAGGTGCTGGAGCAGCAGAGCACAA

GCCTCGGGCAGGACGCACGGCGGCTAGGCGGCCAGGCCGTGGGGACCCGAGACCAGGCGAGCCAATTCCTGG

CCGGCACCGAGGCCACACTCCGCCATGCGAAGACGCTGTTGGCGGCCATCCGGGCTGTGGACCGCACCCTGA

GCGAGCTCATGTCCCAGACGGGCCACCTGGGGCTGGCCAATGCCTCGQCTCCATCAGGTGAGCAGCTGCTCC

GGACACTGGCCGAGGTGGAGCGGCTGCTCTGGGAGATGCGGGCCCGGGACCTCGGGGCCCCGCAGGCAGCAG

CTGAGGCTGAGTTGGCTGCAGCACAGAGATTGCTGGCCCGGGTGCAGGAGCAGCTGAGCAGCCTCTGGGAGG

AGAACCAGGCACTGGCCACACAAACCCGCGACCGGCTGGCCCAGCACGAGGCCGGCCTCATGGACCTCCGAG

AGCCTTTGAACCGGGCAGTGGACGCCACACGGGAGGCCCAGGAGCTCAACAGCCGCAACCAGGAGCGCCTGG

AGGAAGCCCTGCAAAGGAAGCAGGAGCTGTCCCGGGACAATGCCACCCTGCAGGCCACTCTGCATCCGGCTA

GGGACACCCTGGCCAGCGTCTTCAGATTGCTGCACAGCCTGGACCAGGCTAACGAGGAGCTGGACCGCCTCG

CCGCCAGCCTGGACQGGGCTCGGACCCCACTGCTGCAGAGGATGCAGACCTTCTCCCCGGCGGGCAGCAAGC

TGCGTCTAGTGGAGGCCGCCGAGGCCCACGCACAGCAGCTGGGCCAGCTGGCACTCAATCTGTCCAGCATCA

TCCTGGACGTCAACCAGGACCGCCTCACCCAGAGGGCCATCGAGQCCTCCAACGCCTACAGCCGCATCCTGC

AGGCCGTGCAGGCTGCCGAGGATGCTGCTGGCCAGGCCCTGCAGCAGGCGGACCACACGTGGGCGACGQTGG

TGCGGCAGGGCCTCGTGGACCGAGCCCAGCAGCTCCTGGCCAACAGCACTGCACTAGAAGAGGCCATGCTCC

AGGAACAGCAGAGGCTGGGCCTTGTGTGGGCTGCCCTCCAGGGTGCCAGGACCCAGCTCCGAGATGTCCCGG

CCAAGAAGGACCAGCTGGAGGCGCACATCCAGGCGGCGCAGGCCATGCTTGCCATGGACACAGACGAGACAA

GCAAGAAGATCGCACATGCCAACGCTGTGGCTGCTGAAGCCCAGGACACCGCCACCCGTCTGCAGTCCCAGC

TGCAGGCCATGCAGGAGAATGTGGAGCCGTGGCAQGGCCAGTACGAGGGCCTGCGGGGCCAGGACCTGGGCC

AGGCAGTGCTTGACGCAGGCCACTCAGTGTCCACCCTGGAGAAGACGCTGCCCCAGCTGCTGGCCAAGCTGA

GCATCCTGGAGAACCGTGGGGTCCACAACGCCAGCCTGGCCCTGTCCGCCAGCATTCGCCGCGTGCGAGAGC

TCATTGCCCAGGCCCGGGGGGCTGCCAGTAAGGTCAAGGTGCCCATGAAGTTCAACGGGCGCTCAGGGGTGC

AGCTGCGCACCCCACGGGATCTTGCCGACCTTGCTGCCTACACTGCCCTCAAGTTCTACCTGCAGGGCCCAG

AGCCTGAGCCTGGGCAGGGTACCGAGGATCGCTTTGTGATGTACATGGGCAGCCGCCAGGCCACTGGGGACT

ACATGGGTGTGTCTCTGCGTGACAAGAAGGTGCACTCGGTGTATCAGCTGGGTGAGGCGGGCCCTGCAGTCC

TAAGCATCGATGACGACATTGGGGAGCAGTTCGCAGCTGTCAGCCTGOACAGGACTCTCCAGTTTGGCCACA

TGTCCGTCACAGTGGAGAGACAGATGATCCAGGAAACCAAGGGTGACACGGTGGCCCCTGGGCAGAGGGCC

TGCTCAACCTGCGGCCAGACGACTTCGTCTTCTACGTCGGGGGGTACCCCAGTACCTTCACGCCCCCTCCCC

TGCTTCGCTTCCCCGGCTACCGGGGCTGCATCGAGATGGACACGCTGAATGAGGAGGTGGTCAGCCTCTACA

ACTTCGAGAGGACCTTCCAGCTGGACACGGCTGTGGACAGGCCTTGTGCCCGCTCCAAGTCGACCGGCGACC

CGTGGCTCACGGACQGCTCCTACCTGGACGGCACCGGCTTCGCCCGCATCAGCTTCGACAGTCAGATCAGCA

CCACCAAGCGCTTCGAGCAGGAGCTGCGGCTCGTGTCCTACAGCGGGGTGCTCTTCTTCCTGAAGCAGCAGA

TABLE 1G-continued

NOV1d nucleotide sequence (SEQ ID NO:7).

GCCAGTTCCTGTGCTTGGCCGTGCAAGAAGGCAGCCTCGTGCTGTTGTATGACTTTGGGGCTGGCCTGAAAA

AGGCCGTCCCACTGCAGCCCCCACCGCCCCTGACCTCGGCCAGCAAGGCGATCCAGGTGTTCCTGCTGGGGG

GCAGCCGCAAGCGTGTGCTGGTGCGTGTGGAGCGGGCCACGGTGTACAGCGTGGAGCAGGACAATGATCTGG

AGCTGGCCGACGCCTACTACCTGGGGGGCGTGCCGCCCGACCAGCTGCCCCCGAGCCTGCGATCGCTCTTCC

CCACCGGAGGCTCAGTCCGTGGCTGCGTCAAAGGCATCAAGGCCCTGGGCAAGTATGTGGACCTCAAGCGGC

TGAACACGACAGGCGTGAGCGCCGGCTGCACCGCCGACCTGCTGGTGGGGCGCGCCATGACTTTCCATGGCC

ACGGCTTCCTTCGCCTGGCGCTCTCGAACGTGGCACCGCTCACTGGCAACGTCTACTCCGGCTTCGGCTTCC

ACAGCGCCCAGGACAGTGCCCTGCTCTACTACCGGGCGTCCCCCGATGGGCTATGCCAGGTGTCCCTGCAGC

AGGGCCGTGTGAGCCTACAGCTCCTGAGGACTGAAGTGAAAACTCAAGCGGGCTTCGCCGATGGTGCCCCCC

ATTACGTCGCCTTCTACAGCAATGCCACGGGAGTCTGGCTGTATGTCGATGACCAGCTCCAGCAGATGAAGC

CCCACCGGGACCACCCCCCGAGCTCCAGCCGCAGCCTGAGGGCCCCCGACGCTCCTCCTGGGAGGCCTGC

CTGAGTCTGGCACCATTTACAACTTCAGTGGCTGCATCAGCAACGTCTTCGTGCAGCGGCTCCTGGGCCCAC

AGCGCGTATTTGATCTGCAGCAGAACCTGGGCAGCGTCAATGTGAGCACGGGCTGTGCACCCGCCCTGCAAG

CCCAGACCCCGGGCCTGGGGCCTAGAGGACTGCAGGCCACCGCCCGGAAGGCCTCCCGCCGCAGCCGTCAGC

CCCCCCGGCATCCTGCCTGCATGCTGCCCCCACACCTCAGGACCACCCGAGACTCCTACCAGTTTGGGGGTT

CCCTGTCCACTCACCTGGAGTTTGTGGGCATCCTGGCCCGACATAGGAACTGCCCCAGTCTCTCCATGCACG

TCCTCCCGCGAAGCTCCCGAGGCCTCCTCCTCTTCACTGCCCGTCTGAGGCCCGGCAGCCCCTCCCTGGCGC

TCTTCCTGAGCAATGGCCACTTCCTTGCACAGATGGAAGGCCTCGGGACTCCGCTCCGCGCCCAGAGCCGCC

AGCGCTCCCGGCCTGGCCGCTGGCACAAGGTCTCCGTGCGCTGGGAGAAGAACCGGATCCTGCTGGTGACGG

ACGGGGCCCGGGCCTGGAGCCAGGAGGGGCCGCACCGGCAGCACCAGGGGGCAGAGCACCCCCACCCCCACA

CCCTCTTTGTGGGCGGCCTCCCGGCCAGCAGCCACAGCTCCAAACTTCCGGTCACCGTCCGGTTCAGCGGCT

GTGTGAAGAGACTGAGGCTGCACGGGAGGCCCCTGGGGGCCCCACACGGATGGCAGGGGTCACACCCTGCA

TCTTGGGCCCCCTGGAGGCGGGCCTGTTCTTCCCAGGCAGCGGGGGAGTTATCACTTTAGACCTCCCAGGAG

CTACACTGCCTGATGTGCGCCTGGAACTGGAGGTGCGGCCCCTGGCAGTCACCGGACTGATCTTCCACTTGG

GCCAGGCCCGGACGCCCCCCTACTTGCAGTTGCAGGTCCTGCTGCGGGCGGATGACGGAGCAGGGGAGTTCT

CCACGTCAGTGACCCGCCCCTCAGTGCTGTGTGATGGCCAGTGGCACCGGCTAGCGGTGATGAAAAGCGGGA

ATGTGCTCCGGCTGGAGGTGGACGCGCAGAGCAACCACACCGTGGGCCCCTTGCTGGCGGCTGCAGCTGGTG

CCCCAGCCCCTCTGTACCTCGGGGGCCTGCCTGAGCCCATGGCCGTGCAGCCCTGGCCCCCGCCTACTGCG

GCTGCATGAGGAGGCTGGCGGTGAACCGGTCCCCCGTCGCCATGACTCGCTCTGTGGAGGTCCACGGGCAG

TGGGGCCAGTGGCTGCCCAGCCGCCTAGGACACAGCCAACCCCGGCCCTGGTCAGGCCCTGCAGCTGCC

TCACACCGCCCCTTGTGCTCGCCTCATAGGTGTCTATTTGGACTCTAAGCTCTACGGGTGACAGATCTTGTT

TCTGAAGATGGTTTAAGTTATAGCTTCTTAAACGAAAGAATAAAATACTGCAAAATGTTTTTATATTTGGCC

CTTCCACCCATTTTTAATTGTGAGAGATTTGTCACCAATCATCACTGGTTCCTCCTTAAAAATTAAAAAGTA

ACTTCTGTGTAAAAAAAAAA

In a search of public sequence databases, the NOV1d nucleic acid sequence, located on chromsome 20 has 4573 of 4573 bases (100%) identical to a gb:GENBANK-ID:AB011105|acc:ABO 11105.1 rRNA from *Homo sapiens* (*Homo sapiens* mRNA for KIAA0533 protein, partial cds) (E=0.0). Public nucleotide databases include all GenBank databases and the GeneSeq patent database.

The disclosed NOV1d polypeptide (SEQ ID NO:8) encoded by SEQ ID NO:7 has 1640 amino acid residues and is presented in Table 1H using the one-letter amino acid code. Signal P, Psort and/or Hydropathy results predict that NOV1d has no signal peptide and is likely to be localized the cytoplasm with a certainty of 0.5050. In other embodiments, NOV1b may also be localized to the microbody (peroxisome) with acertainty of 0.3000, the lysosome (lumen) with a certainty of 0.2741 or in the mitochondrial matrix space with a certainty of 0.1000.

ptnr:SWISSNEW-ACC:015230 protein from Homo sapiens (Human) (Laminin Alpha-5 Chain) (E=0.0). Public amino acid databases include the GenBank databases, SwissProt, PDB and PIR.

Homologies to any of the above NOV1 proteins will be shared by the other NOV1 proteins insofar as they are homologous to each other as shown below. Any reference to

TABLE 1H

Encoded NOV1d protein seqnence (SEQ ID NO:8).

CDRCQEGHFGFNGCGGCRPCACGPAAEGSECHPQSGQCHCRPGTMGPQCRECAPGYWGLPEQGCRRCQCPGG

RCDPHTGRCNCPPGLSGERCDTCSQQHQVPVPGGPVGHSIHCEVCDHCVVLLLDDLERAGALLPAIHEQLRG

INASSMAWARLHRLNASIADLQSQLRSPLGPRHETAQQLEVLEQQSTSLGQDARRLGGQAVGTRDQASQLLA

GTEATLGHAKTLLAAIRAVDRTLSELMSQTGHLGLANASAPSGEQLLRTLAEVERLLWEMRARDLGAPQAAA

EAELAAAQRLLARVQEQLSSLWEENQALATQTRDRLAQHEAGLMDLREALNRAVDATREAQELNSRNQERLE

EALQRKQELSRDNATLQATLHAARDTLASVFRLLHSLDQAKEELERLAASLDGARTPLLQRMQTFSPAGSKL

RLVEAAEAHAQQLGQLALNLSSIILDVNQDRLTQRAIEASNAYSRILQAVQAAEDAAGQALQQADHTWATVV

RQGLVDRAQQLLANSTALEEAMLQEQQRLGLVWAALQGARTQLRDVRAKKDQLEAHIQAAQAMLAMDTDETS

KKIAHAKAVAAEAQDTATRVQSQLQAMQENVERWQGQYEGLRGQDLGQAVLDAGHSVSTLEKTLPQLLAKLS

ILENRGVHNASLALSASIGRVRELIAQARGAASKVKVPMKFNGRSGVQLRTPRDLADLAAYTALKFYLQGPE

PEPGQGTEDRFVMYMGSRQATGDYMGVSLRDKKVHWVYQLGEAGPAVLSIDEDIGEQFAAVSLDRTLQFGHM

SVTVERQMIQETKGDTVAPGAEGLLNLRPDDFVFYVGGYPSTFTPPPLLRFPGYRGCIEMDTLNEEVVSLYN

FERTFQLDTAVDRPCARSKSTGDPWLTDGSYLDGTGFARISFDSQISTTKRFEQELRLVSYSGVLFFLKQQS

QFLCLAVQEGSLVLLYDFGAGLKKAVPLQPPPPLTSASKAIQVFLLGGSRKRVLVRVERATVYSVEQDNDLE

LADAYYLGGVPPDQLPPSLRWLFPTGGSVRGCVKGIKALGKYVDLKRLNTTGVSAGCTADLLVGRAMTFHGH

GFLRLALSNVAPLTGNVYSGFGFHSAQDSALLYYRASPDGLCQVSLQQGRVSLQLLRTEVKTQAGFADGAPH

YVAFYSNATGVWLYVDDQLQQMKPHRGPPPELQPQPEGPPRLLLGGLPESGTIYNFSGCISNVFVQRLLGPQ

RVFDLQQNLGSVNVSTGCAPALQAQTPGLGPRGLQATARKASRRSRQPARHPACMLPPHLRTTRDSYQFGGS

LSSHLEFVGILARHRNWPSLSMHVLPRSSRGLLLFTARLRPGSPSLALFLSNGHFVAQMEGLGTRLRAQSRQ

RSRPGRWHKVSVRWEKNRILLVTDGARAWSQEGPHRQHQGAEHPQPHTLFVGGLPASSHSSKLPVTVGFSGC

VKRLRLHGRPLGAPTRMAGVTPCILGPLEAGLFFPGSGGVITLDLPGATLPDVGLELEVRPLAVTGLIFHLG

QARTPPYLQLQVLLRADDGAGEFSTSVTRPSVLCDGQWHRLAVMKSGNVLRLEVDAQSNHTVGPLLAAAAGA

PAPLYLGGLPEPMAVQPWPPAYCGCMRRLAVNRSPVAMTRSVEVHGAVGASGCPAA

A search of sequence databases reveals that the NOV1d amino acid sequence has 908 of 913 amino acid residues (99%) identical to, and 1640 of 1645 amino acid residues (99%) identical to, and 1640 of 1645 amino acid residues (99%) similar to, the 1645 amino acid residue NOV1 is assumed to refer to all four of the NOV1 proteins in general, unless otherwise noted.

The disclosed NOV1a polypeptide has homology to the amino acid sequences shown in the BLASTP data listed in Table 1I.

TABLE 1I

BLAST results for NOV1a

| Gene Index/ Identifier | Protein/Organism | Length (aa) | Identity (%) | Positives (%) | Expect |
|---|---|---|---|---|---|
| gi\|7459688\|pir\|\|T10053 | laminin alpha 5 chain - mouse (fragment) | 3635 | 2441/3319 (73%) | 2666/3319 (79%) | 0.0 |
| gi\|2497593\|sp\|Q00174\| | Laminin alpha | 3712 | 793/2179 | 1106/2179 | 0.0 |

TABLE 1I-continued

BLAST results for NOV1a

| Gene Index/ Identifier | Protein/Organism | Length (aa) | Identity (%) | Positives (%) | Expect |
|---|---|---|---|---|---|
| LMA_DROME gi\|14786772\|ref\|XP_037217.1\| (XM_037217) | chain precursor laminin, alpha 5 [*Homo sapiens*] | 1634 | (36%) 1060/1213 (87%) | (50%) 1063/1213 (87%) | 0.0 |
| gi\|2281044\|emb\|CAB09137.1\| (Z95636) | laminin alpha 5 chain [*Homo sapiens* | 953 | 571/620 (92%) | 571/620 (92%) | 0.0 |
| gi\|17136292\|ref\|NP_476617.1\| (NM_057269) | LanA-P1; headline; laminin; laminin A; laminin alpha; laminin alpha3,5; laminin alpha-chain [*Drosophila melanogaster*] | 3712 | 790/2179 (36%) | 1105/2179 (50%) | 0.0 |

The homology between these and other sequences is shown graphically in the ClustalW analysis shown in Table 1J. In the ClustalW alignment of the NOV1 proteins, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 1J

ClustalW Analysis of NOV1

1) Novel NOV1a (SEQ ID NO:2)
2) Novel NOV1b (SEQ ID NO:4)
3) Novel NOV1c (SEQ ID NO:6)
4) Novel NOV1d (SEQ ID NO:8)
5) gi|7459688|pir||T10053 laminin alpha 5 chain - mouse (fragment) (SEQ ID NO:47)
6) gi|2497593|sp|Q00174|LMA_DROME Laminin alpha chain precursor (SEQ ID NO:48)
7) gi|14786772|ref|XP_037217.1|(XM_037217) laminin, alpha 5 [*Homo sapiens*] (SEQ ID NO:49)
8) gi|2281044|emb|CAB09137.1| (Z95636) laminin alpha 5 chain [*Homo sapiens*] (SEQ ID NO:50)
9) gi|17136292|ref|NP_476617.1| (NM_057269) LanA-P1; headline; laminin; laminin A; laminin alpha; laminin alpha3,5; laminin alpha-chain [*Drosophila melanogaster*] (SEQ ID NO:51)

```
                                     10        20        30        40        50        60
                                ....|....|....|....|....|....|....|....|....|....|....|....|
            NOV1a               MAKRLCAGSALCVRGPRGPAPLLLHPPYFNLAEGARIAASATCGEEAPARGSPRPTEDLY    60
            NOV1b               ------------------------------------------------------------     1
            NOV1c               MAKRLCAGSALCVRGPRGPAPLLLHPPYFNLAEGARIAASATCGEEAPARGSPRPTEDLY    60
            NOV1d               ------------------------------------------------------------     1
            gi|7459688|pir|     ---------------------------------------------------------DLY     3
            gi|2497593|sp|Q     MGHGVASIGALLVILAISYCQAELRPPYFNLATGRKIYATATCGPDTD-------GPELY    53
            gi|14786772|ref     ------------------------------------------------------------     1
            gi|2281044|emb|     ------------------------------------------------------------     1
            gi|17136292|ref     MGHGVASIGALLVILAISYCQAELTPPYFNLATGRKIYATATCGQDTD------GPELY    53

70        80        90       100       110       120
                                ....|....|....|....|....|....|....|....|....|....|....|....|
            NOV1a               CKLVGG--PVAGGDPNQTIQGQYCDICTAANSNKAHPASNAIDGTERWWQSPPLSRGLEYN   119
            NOV1b               ------------------------------------------------------------     1
            NOV1c               CKLVGG--PVAGGDPNQTIQGQYCDICTAANSNKAHPASNAIDGTERWWQSPPLSRGLEYN   119
            NOV1d               ------------------------------------------------------------     1
            gi|7459688|pir|     CKLVGG--PVAGGDPNQTIQGQYCDICTAANSNKAHPVSNAIDGTERWWQSPPLSRGLEYN    62
            gi|2497593|sp|Q     CKLVGANTEHDHIDYSVIQGQVCDYCDPYVPERNHPPENAIDGTEAWWQSPPLSRGMKFN   113
            gi|14786772|ref     ------------------------------------------------------------     1
            gi|2281044|emb|     ------------------------------------------------------------     1
            gi|17136292|ref     CKLVGANTEHDHIDYSVIQGQVCDYCDPYVPERNHPPENAIDGTEAWWQSPPLSRGMKFN   113

130       140       150       160       170       180
                                ....|....|....|....|....|....|....|....|....|....|....|....|
            NOV1a               EVNVTLDLGQVFHVAYVLIKFANSPRPDLWVLERSMDFGRTYQPWQFFAASKRDCLERFG   179
            NOV1b               ------------------------------------------------------------     1
            NOV1c               EVNVTLDLGQVFHVAYVLIKFANSPRPDLWVLERSMDFGRTYQPWQFFAASKRDCLERFG   179
            NOV1d               ------------------------------------------------------------     1
            gi|7459688|pir|     EVNVTLDLGQVFHVAYVLIKFANSPRPDLWVLERSTDFGHTYQPWQFFAASKRDCLERFG   122
            gi|2497593|sp|Q     EVNVTINFEQEFHVAYLFIRMGNSPRPGLWTLEKSMDYGKTWTPWQHFSDTPADCETYFG   173
            gi|14786772|ref     ------------------------------------------------------------     1
            gi|2281044|emb|     ------------------------------------------------------------     1
            gi|17136292|ref     EVNVTINFEQEFHVAYLFIRMGNSPRPGLWTLEKSMDYGKTWTPWQHFSDTPADCETYFG   173
```

TABLE 1J-continued

ClustalW Analysis of NOV1

```
                          190       200       210       220       230       240
                     ....|....|....|....|....|....|....|....|....|....|....|....|
NOV1a                PQTLERITRDDAAICTTEYSRIVPLENGEIVVSLVNGRPGAMNFSYSPLLREFTKATNVR      239
NOV1b                ------------------------------------------------------------        1
NOV1c                PQTLERITRDDAAICTTEYSRIVPLENGEIVVSLVNGRPGAMNFSYSPLLREFTKATNVR      239
NOV1d                ------------------------------------------------------------        1
gi|7459688|pir|      PRTLERITQDDDVICTTEYSRIVPLENGEIVVSLVNGRPGALNFSYSPLLRDFTKATNIR      182
gi|2497593|sp|Q      KDTYKPITRDDDVICTTEYSKIVPLENGEIPVMLLNERPSSTNYFNSTVLQEWTRATNVR      233
gi|14786772|ref      ------------------------------------------------------------        1
gi|2281044|emb|      ------------------------------------------------------------        1
gi|17136292|ref      KDTYKPITRDDDVICTTEYSKIVPLENGEIPVMLLNERPSSTNYFNSTVLQEWTRATNVR      233

250       260       270       280       290       300
                     ....|....|....|....|....|....|....|....|....|....|....|....|
NOV1a                LRFLRTNTLLGHLMGKALRDPTVTRRYYYSIKDISIGGRCVCHGHADACDAKDPTDPF-R      298
NOV1b                ------------------------------------------------------------        1
NOV1c                LRFLRTNTLLGHLMGKALRDPTVTRRYYYSIKDISIGGRCVCHGHADACDAKDPTDPF-R      298
NOV1d                ------------------------------------------------------------        1
gi|7459688|pir|      LRFLRTNTLLGHLMGKALRDPTVTRRYYYSIKDISIGGRCVCHGHADVCDAKDPLDPF-R      241
gi|2497593|sp|Q      IRLLRTKNLLGHLMSVARQDPTVTRRYFYSIKDISIGGRCMCNGHADTCDVKDPKSPVRI      293
gi|14786772|ref      ------------------------------------------------------------        1
gi|2281044|emb|      ------------------------------------------------------------        1
gi|17136292|ref      IRLLRTKNLLGHLMSVARQDPTVTRRYFYSIKDISIGGRCMCNGHADTCDVKDPKSPVRI      293

310       320       330       340       350       360
                     ....|....|....|....|....|....|....|....|....|....|....|....|
NOV1a                LQCTCQHNTCGGTCDRCCPGFNQQPWKPATANSANECQ-CECYGHATDCYYDPEVDRRRA      357
NOV1b                ------------------------------------------------------------        1
NOV1c                LQCTCQHNTCGGTCDRCCPGFNQQPWKPATANSANECQ-CECYGHATDCYYDPEVDRRRA      357
NOV1d                ------------------------------------------------------------        1
gi|7459688|pir|      LQCACQHNTCGGSCDRCCPGFNQQPWKPATTDSANECQSCNCHGHAYDCYYDPEVDRRNA      301
gi|2497593|sp|Q      LACRCQHHTCGIQCNECCPGFEQKKWRQNTNARPFNCEPCNCHGHSNECKYDEEVNRKGL      353
gi|14786772|ref      ------------------------------------------------------------        1
gi|2281044|emb|      ------------------------------------------------------------        1
gi|17136292|ref      LACRCQHHTCGIQCNECCPGFEQKKWRQNTNARPFNCEPCNCHGHSNECKYDEEVNRKGL      353

370       380       390       400       410       420
                     ....|....|....|....|....|....|....|....|....|....|....|....|
NOV1a                SQSLDGTYQGGGVCIDCQHHTTGVNCERCLPGFYRSPNHPLDSPHVCRGCNCESDFTDGT      417
NOV1b                ------------------------------------------------------------        1
NOV1c                SQSLDGTYQGGGVCIDCQHHTTGVNCERCLPGFYRSPNHPLDSPHVCRGCNCESDFTDGT      417
NOV1d                ------------------------------------------------------------        1
gi|7459688|pir|      SQNQDNVYQGGGVCLDCQHHTTGINCERCLPGFFRAPDQPLDSPHVCRPCDCESDFTDGT      361
gi|2497593|sp|Q      SLDIHGHYDGGGVCQNCQHNTCGINCNKCKPKYYRPKGKHWNETDVCSPCQCDYFFSTGH      413
gi|14786772|ref      ------------------------------------------------------------        1
gi|2281044|emb|      ------------------------------------------------------------        1
gi|17136292|ref      SLDIHGHYDGGGVCQNCQHNTCGINCNKCKPKYYRPKGKHWNETDVCSPCQCDYFFSTGH      413

430       440       450       460       470       480
                     ....|....|....|....|....|....|....|....|....|....|....|....|
NOV1a                CEDLTGRCYCRPNFSGERCDVCAEGFTGFPSCY-REHLPGNDTREQVLPAGGQIVSCDCSA     476
NOV1b                ------------------------------------------------------------        1
NOV1c                CEDLTGRCYCRPNFSGERCDVCAEGFTGFPSCY-REHLPGNDTREQVLPAGGQIVSCDCSA     476
NOV1d                ------------------------------------------------------------        1
gi|7459688|pir|      CEDLTGRCYCRPNFTGELCAACAEGYTDFPHCYPLPSFPHNDTREQVLPAGGQIVNCDCNA     421
gi|2497593|sp|Q      CEEETGNCECRAAFQPPSCDSCAYGYYGYPNCR--------------------ECECNL      452
gi|14786772|ref      ------------------------------------------------------------        1
gi|2281044|emb|      ------------------------------------------------------------        1
gi|17136292|ref      CEEETGNCECRAAFQPPSCDSCAYGYYGYPNCR--------------------ECECNL      452

490       500       510       520       530       540
                     ....|....|....|....|....|....|....|....|....|....|....|....|
NOV1a                AGTQGNACRKDPRVGRCLCKPNFQGTHCELCAPGFY-GPGCPASVPALEWPMTAVTLTQA      535
NOV1b                ------------------------------------------------------------        1
NOV1c                AGTQGNACRKDPRVGRCLCKPNFQGTHCELCAPGFY-GPGCPASVPALEWPMTAVTLTQA      535
NOV1d                ------------------------------------------------------------        1
gi|7459688|pir|      AGTQGNACRKDPRLGRCVCKPNFRGAHCELCAPGFH-GPSCHPCQCSSPGVANSLCDPES      480
gi|2497593|sp|Q      NGTNGYHCEAESGQ-QCPCKINFAGAYCKQCAEGYYGFPECKACECNKIGSITNDCNVTT      511
gi|14786772|ref      ------------------------------------------------------------        1
gi|2281044|emb|      ------------------------------------------------------------        1
gi|17136292|ref      NGTNGYHCEAESGQ-QCPCKINFAGAYCKQCAEGYYGFPECKACECNKIGSITNDCNVTT      511
```

TABLE 1J-continued

ClustalW Analysis of NOV1

```
                              550       560       570       580       590       600
                         ....|....|....|....|....|....|....|....|....|....|....|....|
NOV1a            SAGAEWASRGPHVIAVPPATFTSLSASHPLRSAVCGCSPAGTLPEGCD-EAGRCLCQPEF        594
NOV1b            ------------------------------------------------------------          1
NOV1c            SAGAEWASRGPHVIAVPPATFTSLSASHPLRSAVCGCSPAGTLPEGCD-EAGRCLCQPEF        594
NOV1d            ------------------------------------------------------------          1
gi|7459688|pir|  GQ-----CMCRTGFEGDRCDHCALGYFHFPLCQLCGCSPAGTLPEGCD-EAGRCQCRPGF        534
gi|2497593|sp|Q  G-----ECKCLTNFGGDNCERCKHGYFNYPTCSYCDCDNQGTESEICNKQSGQCICREGF        566
gi|14786772|ref  ------------------------------------------------------------          1
gi|2281044|emb|  ------------------------------------------------------------          1
gi|17136292|ref  G-----ECKCLTNFGGDNCERCKHGYFNYPTCSYCDCDNQGTESEICNKQSGQCICREGF        566

610       620       630       640       650       660
                         ....|....|....|....|....|....|....|....|....|....|....|....|
NOV1a            AGPHCDRCRPGYHGFPNCAACTCDPRGALDQLCGAGGLCRCRPGYTGTACQECSPGFHGF        654
NOV1b            ------------------------------------------------------------          1
NOV1c            AGPHCDRCRPGYHGFPNCAACTCDPRGALDQLCGAGGLCRCRPGYTGTACQECSPGFHGF        654
NOV1d            ------------------------------------------------------------          1
gi|7459688|pir|  DGPHCDRCLPGYHGYPDCHACACDPRGALDQQCGVGGLCRCRPGNTGATCQECSPGFYGF        594
gi|2497593|sp|Q  GGPRCDQCLPGFYNYPDCKPCNCSSTGSSAITCDNTGKCNCLNNFAGKQCTLCTAGYYSY        626
gi|14786772|ref  ------------------------------------------------------------          1
gi|2281044|emb|  ------------------------------------------------------------          1
gi|17136292|ref  GGPRCDQCLPGFYNYPDCKPCNCSSTGSSAITCDNTGKCNCLNNFAGKQCTLCTAGYYSY        626

670       680       690       700       710       720
                         ....|....|....|....|....|....|....|....|....|....|....|....|
NOV1a            PSCPATALLKAPCTQPVTPGVGSAAAGPVRGCGVTHVCPVPTTSPTAKPLFTAGSCHPAG        714
NOV1b            ------------------------------------------------------------          1
NOV1c            PSCPATALLKAPCTQPVTPGVGSAAAGPVRGCGVTRVCPVPTTSPTAKLALATLPVWP--        712
NOV1d            ------------------------------------------------------------          1
gi|7459688|pir|  PSCIPCHCSADGSLHTTCDPTTGQCRCRPRVTGLHCDMCVPG--AYNFPYCEAGSCHPAG        652
gi|2497593|sp|Q  PDCLPCHCDSHGSQGVSCN-SDGQCLCQPNFDGRQCDSCKEG--FYNFPSCEDCNCDPAG        683
gi|14786772|ref  ------------------------------------------------------------          1
gi|2281044|emb|  ------------------------------------------------------------          1
gi|17136292|ref  PDCLPCHCDSHGSQGVSCN-SDGQCLCQPNFDGRQCDSCKEG--FYNFPSCEDCNCDPAG        683

730       740       750       760       770       780
                         ....|....|....|....|....|....|....|....|....|....|....|....|
NOV1a            LAPVPD--ALPEVSPPCMCRAHVEGPSCDRCKPGFWGLSPSNPEGCTRCSCDLRGTLGGV        772
NOV1b            ------------------------------------------------------------          1
NOV1c            --PVPD--ALPEAQVPCMCRAHVEGPSCDRCKPGFWGLSPSNPEGCTRCSCDLRGTLGGV        768
NOV1d            ------------------------------------------------------------          1
gi|7459688|pir|  LAPAND--ALPETQAPCMCRAHVEGPSCDRCKPGYWGLSASNPEGCTRCSCDPRGTLGGV        710
gi|2497593|sp|Q  VIDKFAGCGSVPVGELCKCKERVTGRICNECKPLYWNLNISNTEGCEICDCWTDGTISAL        743
gi|14786772|ref  ------------------------------------------------------------          1
gi|2281044|emb|  ------------------------------------------------------------          1
gi|17136292|ref  VIDKFAGCGSVPVGELCKCKERVTGRICNECKPLYWNLNISNTEGCEICDCWTDGTISAL        743

790       800       810       820       830       840
                         ....|....|....|....|....|....|....|....|....|....|....|....|
NOV1a            AECQ-GTGQCFCKPHVCGQACASCKDGFFGLDQADYFGCRSCRCDIGGSLGQSCEPRTGV        831
NOV1b            ------------------------------------------------------------          1
NOV1c            AECQPGTGQCFCKPHVCGQACASCKDGFFGLDQADYFGCRSCRCDIGGSLGQSCEPRTGV        828
NOV1d            ------------------------------------------------------------          1
gi|7459688|pir|  TECQ-GNGQCFCKAHVCGKTCAACKDGFFGLDYADYFGCRSCRCDVGGSLGQSCEPKTGA        769
gi|2497593|sp|Q  DTCTSKSGQCPCKPHTQGRRCQECRDGTFDLDSASLFGCKDCSCDVGGSWQSVCDKISGQ        803
gi|14786772|ref  ------------------------------------------------------------          1
gi|2281044|emb|  ------------------------------------------------------------          1
gi|17136292|ref  DTCTSKSGQCPCKPHTQGRRCQECRDGTFDLDSASLFGCKDCSCDVGGSWQSVCDKISGQ        803

850       860       870       880       890       900
                         ....|....|....|....|....|....|....|....|....|....|....|....|
NOV1a            CRCRPNTQGPTCSEPARDHYLPDLHHLRLELEEAATPEGHAVRFGFNPLEFENFSWRGYA        891
NOV1b            ------------------------------------------------------------          1
NOV1c            CRCRPNTQGPTCSEPARDHYLPDLHHLRLELEEAATPEGHAVRFGFNPLEFENFSWRGYA        888
NOV1d            ------------------------------------------------------------          1
gi|7459688|pir|  CRCRPNTQGPTCSEPAKDHYLPDLHHMRLELEEAATPEGHAVRFGFNPLEFENFSWRGYA        829
gi|2497593|sp|Q  CKCHPRITGLACTQPLTTHFFPTLHQFQYEYEDGSLPSGTQVRYDYDEAAFPGFSSKGYV        863
gi|14786772|ref  ------------------------------------------------------------          1
gi|2281044|emb|  ------------------------------------------------------------          1
gi|17136292|ref  CKCHPRITGLACTQPLTTHFFPTLHQFQYEYEDGSLPSGTQVRYDYDEAAFPGFSSKGYV        863
```

TABLE 1J-continued

ClustalW Analysis of NOV1

```
                         910       920       930       940       950       960
                    ....|....|....|....|....|....|....|....|....|....|....|....|
NOV1a               QMAPVQPRIVARLNLTSPDLFWLVFRYVNRGAMSVSGRVSVREEGRSATCANCTAQSQPV     951
NOV1b               ------------------------------------------------------------       1
NOV1c               QMAPVQPRIVARLNLTSPDLFWLVFRYVNRGAMSVSGRVSVREEGRSAACANCTAQSQPV     948
NOV1d               ------------------------------------------------------------       1
gi|7459688|pir|     HMMAIQPRIVARLNVTSPDLFRLVFRYVNRDSTSVNGQISVREEGKLSSCTNCTEQSQPV     889
gi|2497593|sp|Q     VFNAIQNDVRNEVNVFKSSLYRIVLRYVNPNAENCTATISVTSDNPLEVDQHVKVLLQPT     923
gi|14786772|ref     ------------------------------------------------------------       1
gi|2281044|emb|     ------------------------------------------------------------       1
gi|17136292|ref     VFNAIQNDVRNEVNVFKSSLYRIVLRYVNPNAENCTATISVTSDNPLEVDQHVKVLLQPT     923

970       980       990      1000      1010      1020
                    ....|....|....|....|....|....|....|....|....|....|....|....|
NOV1a               AFPPSTEPAFITVPQRGFGEPPFVLNPGTWALRVEAEG-VLLDYVVLLPSAYYEAALLQLR    1010
NOV1b               ------------------------------------------------------------       1
NOV1c               AFPPSTEPAFITVPQRGFGEPPFVLNPGTWALRVEAEG-VLLDYVVLLPSAYYEAALLQLR    1007
NOV1d               ------------------------------------------------------------       1
gi|7459688|pir|     AFPPSTEPAFVTVPQRGFGEPPFVIWALLVEAEG-VLLDYVVLLPSTYYEAALLQHR         948
gi|2497593|sp|Q     SEP---QFVTVAGPLGVKPSAIVLDPGRYVFTTKANKNVMLDYFVLLPAAYYEAGILTRH     980
gi|14786772|ref     ------------------------------------------------------------       1
gi|2281044|emb|     ------------------------------------------------------------       1
gi|17136292|ref     SEP---QFVTVAGPLGVKPSAIVLDPGRYVFTTKANKNVMLDYFVLLPAAYYEAGILTRH     980

1030      1040      1050      1060      1070      1080
                    ....|....|....|....|....|....|....|....|....|....|....|....|
NOV1a               VTEACTYRPSAQQSPPSCLLYTHLPLDGFPSAAGLEALCRQDNSLPRPCPTEQLSPSHPP     1070
NOV1b               ------------------------------------------------------------       1
NOV1c               VTEACTYRPSAQQSPPSCLLYTHLPLDGFPSAAGLEALCRQDNSLPRPCPTEQLSPSHPP     1067
NOV1d               ------------------------------------------------------------       1
gi|7459688|pir|     VTEACTYRPSALHSTENCLVYAHLPLDGFPSAAGTEALCRHDNSLPRPCPTEQLSPSHPP     1008
gi|2497593|sp|Q     ISNPCELGNMELCRHYKYASVEVFSPAATPFVIGENSKPTNPVETYTDPEHLQIVSHVGD    1040
gi|14786772|ref     ------------------------------------------------------------       1
gi|2281044|emb|     ------------------------------------------------------------       1
gi|17136292|ref     ISNPCELGNMELCRHYKYASVEVFSPAATPFVIGENSKPTNPVETYTDPEHLQIVSHVGD    1040

1090      1100      1110      1120      1130      1140
                    ....|....|....|....|....|....|....|....|....|....|....|....|
NOV1a               LITCTGSDVDVQLQVAVPQPGRYALVVEYANEDAR-QEVGVAVHTPQRAPQQGLLSLHPC    1129
NOV1b               ------------------------------------------------------------       1
NOV1c               LITCTGSDVDVQLQVAVPQPGRYALVVEYANEDAR-QEVGVAVHTPQRAPQQGLLSLHPC    1126
NOV1d               ------------------------------------------------------------       1
gi|7459688|pir|     LATCFGSDVDIQLEMAVPQPGQYVLVVEYVGEDSH-QEMGVAVHTPQRAPQQGVLNLHPC    1067
gi|2497593|sp|Q     IPVLSGSQNELHYIVDVPRSGRYIFVIDYISDRNFPDSYYINLKLKDNPDSETSVLLYPC    1100
gi|14786772|ref     ------------------------------------------------------------       1
gi|2281044|emb|     ------------------------------------------------------------       1
gi|17136292|ref     IPVLSGSQNELHYIVDVPRSGRYIFVIDYISDRNFPDSYYINLKLKDNPDSETSVLLYPC    1100

1150      1160      1170      1180      1190      1200
                    ....|....|....|....|....|....|....|....|....|....|....|....|
NOV1a               LYSTLCRGTARDTQDHLAVFHLDSEASVRLT----AEQARFFLHGVTLVPIEEFSPEFVE    1185
NOV1b               ------------------------------------------------------------       1
NOV1c               LYSTLCRGTARDTQDHLAVFHLDSEASVRLT----AEQARFFLHGVTLVPIEEFSPEFVE    1182
NOV1d               ------------------------------------------------------------       1
gi|7459688|pir|     PYSSLCRSPARDTQHHLAIFHLDSEASIRLT----AEQAHFFLHSVTLVPVEEFSTEFVE    1123
gi|2497593|sp|Q     LYSTICRTSVNEDGMEKSFYINKEDLQPVIISADIEDGSRFPIISVTAIPVDQWSIDYIN    1160
gi|14786772|ref     ------------------------------------------------------------       1
gi|2281044|emb|     ------------------------------------------------------------       1
gi|17136292|ref     LYSTICRTSVNEDGMEKSFYINKEDLQPVIISADIEDGSRFPIISVTAIPVDQWSIDYIN    1160

1210      1220      1230      1240      1250      1260
                    ....|....|....|....|....|....|....|....|....|....|....|....|
NOV1a               PRVSCISSHGAFGPNSAACLPSRFPKPPQPIILRDCQVIPLPPGLPLTHAQDLTPAMSPA    1245
NOV1b               ------------------------------------------------------------       1
NOV1c               PRVSCISSHGAFGPNSAACLPSRFPKPPQPIILRDCQVIPLPPGLPLTHAQDLTPAMSPA    1242
NOV1d               ------------------------------------------------------------       1
gi|7459688|pir|     PRVFCVSSHGTFNPSSAACLASRFPKPPQPIILKDCQVLPLPPGLPLTQSQELSPGAPPE    1183
gi|2497593|sp|Q     PSPVCVIHDQQCATPKFRSVPD-----------------SKKIEFETDHEDRIATNKPPY    1203
gi|14786772|ref     ------------------------------------------------------------       1
gi|2281044|emb|     ------------------------------------------------------------       1
gi|17136292|ref     PSPVCVIHDQQCATPKFRSVPD-----------------SKKIEFETDHEDRIATNKPPY    1203
```

TABLE 1J-continued

ClustalW Analysis of NOV1

```
                      1270       1280       1290       1300       1310       1320
                 ....|....|....|....|....|....|....|....|....|....|....|....|
NOV1a            GPRPRPPTAVDPDAEPTLLREPQATVVFTTHVPTLGRYAFLLHGYQPAHPTFPVEVLINA       1305
NOV1b            ------------------------------------------------------------          1
NOV1c            GPRPRPPTAVDPDAEPTLLREPQATVVFTTHVPTLGRYAFLLHGYQPAHPTFPVEVLINA       1302
NOV1d            ------------------------------------------------------------          1
gi|7459688|pir|  GPQPRPPTAVDPNAEPTLLRHPQGTVVFTTQVPTLGRYAFLLHGYQPVHPSFPVEVLING       1243
gi|2497593|sp|Q  ASLDERVKLVHLDSQ----NEATIVIESKVDATKPNLFVILVKYYQPSHPKYQVYYTLTA       1259
gi|14786772|ref  ------------------------------------------------------------          1
gi|2281044|emb|  ------------------------------------------------------------          1
gi|17136292|ref  ASLDERVKLVHLDSQ----NEATIVIESKVDATKPNLFVILVKYYQPSHPKYQVYYTLTA       1259

1330       1340       1350       1360       1370       1380
                 ....|....|....|....|....|....|....|....|....|....|....|....|
NOV1a            GRV-WQGHANASFCPHGYGCRTLVVCEGQALLDVTHSELTVTVRVPKGRWLWLDYVLVVP       1364
NOV1b            ------------------------------------------------------------          1
NOV1c            GRV-WQGHANASFCPHGYGCRTLVVCEGQALLDVTHSELTVTVRVPKGRWLWLDYVLVVP       1361
NOV1d            ------------------------------------------------------------          1
gi|7459688|pir|  GRI-WQGHANASFCPHGYGCRTLVVCEGQTMLDVTDNELTVTVRVPEGRWLWLDYVLVVP       1302
gi|2497593|sp|Q  GKNQYDGKFDIQHCPSSSGCRGVIRPAGEGSFEIDD-EFKFTITTDRSQSVWLDYLVVVP       1318
gi|14786772|ref  ------------------------------------------------------------          1
gi|2281044|emb|  ------------------------------------------------------------          1
gi|17136292|ref  GKNQYDGKFDIQHCPSSSGCRGVIRPAGEGSFEIDD-EFKFTITTDRSQSVWLDYLVVVP       1318

1390       1400       1410       1420       1430       1440
                 ....|....|....|....|....|....|....|....|....|....|....|....|
NOV1a            ENVYSFGYLREEPLDKSYDFISHCAAQGYHISPSSSSLFCRNAAASLSLFYNNGARPCGC       1424
NOV1b            ------------------------------------------------------------          1
NOV1c            ENVYSFGYLREEPLDKSYDFISHCAAQGYHISPSSSSLFCRNAAASLSLFYNNGARPCGC       1421
NOV1d            ------------------------------------------------------------          1
gi|7459688|pir|  EDAYSSSYLQEEPLDKSYDFISHCATQGYHISPSSSSPFCRNAATSLSLFYNNGALPCGC       1362
gi|2497593|sp|Q  LKQYNDDLLVEETFDQTKEFIQNCGHDHFHITHN-ASDFCKKSVFSLTADYNSGALPCNC       1377
gi|14786772|ref  ------------------------------------------------------------          1
gi|2281044|emb|  ------------------------------------------------------------          1
gi|17136292|ref  LKQYNDDLLVEETFDQTKEFIQNCGHDHFHITHN-ASDFCKKSVFSLTADYNSGALPCNC       1377

1450       1460       1470       1480       1490       1500
                 ....|....|....|....|....|....|....|....|....|....|....|....|
NOV1a            HEVGATGPTCEPFGGQCPCHAHVIGRDCSRCATGYWGFPNCRACDCG-ARLCDELTGQCI       1483
NOV1b            ------------------------------------------------------------          1
NOV1c            HEVGATGPTCEPFGGQCPCHAHVIGRDCSRCATGYWGFPNCRACDCG-ARLCDELTGQCI       1480
NOV1d            ------------------------------------------------------------          1
gi|7459688|pir|  HEVGAVSPTCEPFGGQCPCRGHVIGRDCSRCATGYWGFPNCRPCDCG-ARLCDELTGQCI       1421
gi|2497593|sp|Q  DYAGSTSFECHPFGGQCQCKPNVIERTCGRCRSRYYGFPDCKPCKCPNSAMCEPTIGECM       1437
gi|14786772|ref  ------------------------------------------------------------          1
gi|2281044|emb|  ------------------------------------------------------------          1
gi|17136292|ref  DYAGSTSFECHPFGGQCQCKPNVIERTCGACRSRYYGFPDCKPCKCPNSAMCEPTIGECM       1437

1510       1520       1530       1540       1550       1560
                 ....|....|....|....|....|....|....|....|....|....|....|....|
NOV1a            CPPRTIPPDCLLCQPQTFGCHPLVGCEECNCSGPGIQELTDPTCDTDSGQCRCRPNVTGR       1543
NOV1b            ------------------------------------------------------------          1
NOV1c            CPPRTIPPDCLLCQPQTFGCHPLVGCEECNCSGPGIQELTDPTCDTDSGQCRCRPNVTGR       1540
NOV1d            ------------------------------------------------------------          1
gi|7459688|pir|  CPPRTVPPDCLVCQPQSFGCHPLVGCEECNCSGPGVQELTDPTCDMDSGQCRCRPNVAGR       1481
gi|2497593|sp|Q  CPPNVIGDLCEKCAPNTYGFHQVIGCEECACNPMGIANGNS-QCDLFNGTCECRQNIEGR       1496
gi|14786772|ref  ------------------------------------------------------------          1
gi|2281044|emb|  ------------------------------------------------------------          1
gi|17136292|ref  CPPNVIGDLCEKCAPNTYGFHQVIGCEECACNPMGIANGNS-QCDLFNGTCECRQNIEGR       1496

1570       1580       1590       1600       1610       1620
                 ....|....|....|....|....|....|....|....|....|....|....|....|
NOV1a            RCDTCSPGFHGYPRCRPCDCHEAGTAPGVCDPLTGQCYCKENVQGPKCDQCSLGTFSLDA       1603
NOV1b            ------------------------------------------------------------          1
NOV1c            RCDTCSPGFHGYPRCRPCDCHEAGTAPGVCDPLTGQCYCKENVQGPKCDQCSLGTFSLDA       1600
NOV1d            ------------------------------------------------------------          1
gi|7459688|pir|  RCDTCAPGFYGYPSCRPCDCHEAGTMASVCDPLTGQCHCKENVQGSRCDQCRVGTYSLDA       1541
gi|2497593|sp|Q  ACDVCSNGYFNFPHCEQCSCHKPGTELEVCDKIDGACFCKKNVVGRDCDQCVDGTYNLQE       1556
gi|14786772|ref  ------------------------------------------------------------          1
gi|2281044|emb|  ------------------------------------------------------------          1
gi|17136292|ref  ACDVCSNGYFNFPHCEQCSCHKPGTELEVCDKIDGACFCKKNVVGRDCDQCVDGTYNLQE       1556
```

TABLE 1J-continued

ClustalW Analysis of NOV1

```
                         1630       1640       1650       1660       1670       1680
                   ....|....|....|....|....|....|....|....|....|....|....|....|
NOV1a              ANPKGCTRCFCFGATERCRSSSYTRQEFVDMEGWVLLSTDRQVVPHERQPGTEMLRADLR        1663
NOV1b              ------------------------------------------------------------           1
NOV1c              ANPKGCTRCFCFGATERCRSSSYTRQEFVDMEGWVLLSTDRQVVPHERQPGTEMLRADLR        1660
NOV1d              ------------------------------------------------------------           1
gi|7459688|pir|    ANPKGCTRCFCFGATERCGNSNLARHEFVDMEGWVLLSSDRQVVPHEHRPEIELLHADLR        1601
gi|2497593|sp|Q    SNPDGCTTCFCFGKTSRCDSAYLRVYNVSLLKHVSITTPEFHEESIKFDMWPVPADEILL        1616
gi|14786772|ref    ------------------------------------------------------------           1
gi|2281044|emb|    ------------------------------------------------------------           1
gi|17136292|ref    SNPDGCTTCFCFGKTSRCDSAYLRVYNVSLLKHVSITTPEFHEESIKFDMWPVPADEILL        1616

1690       1700       1710       1720       1730       1740
                   ....|....|....|....|....|....|....|....|....|....|....|....|
NOV1a              HVPEAVPEAFPELYWQAPPSYL---------GDRVSSYGGTLRYELHSETQRGDVFVPME        1714
NOV1b              ------------------------------------------------------------           1
NOV1c              HVPEAVPEAFPELYWQAPPSYL---------GDRVSSYGGTLHYELHSETQRGDIFIPYE        1711
NOV1d              ------------------------------------------------------------           1
gi|7459688|pir|    ----SVADTFSELYWQAPPSYL---------GDRVSSYGGTLRYELHSETQRGDVFVPME        1648
gi|2497593|sp|Q    NETTLKADFTLREVNDERPAYFGVLDYLLNQNNHISAYGGDLAYTLHFTSGFDG---KYI        1673
gi|14786772|ref    ------------------------------------------------------------           1
gi|2281044|emb|    ------------------------------------------------------------           1
gi|17136292|ref    NETTLKADFTLREVNDERPAYFGVLDYLLNQNNHISAYGGDLAYTLHFTSGFDG---KYI        1673

1750       1760       1770       1780       1790       1800
                   ....|....|....|....|....|....|....|....|....|....|....|....|
NOV1a              SRPDVVLQGNQMSITFLEPAYPTPGHVHRGQLQLVEGNFRHTETRNTVSREELMMVLASL        1774
NOV1b              ------------------------------------------------------------           1
NOV1c              SRPDVVLQGNQMSITFLEPAYPTPGHVHRGQLQLVEGNFRHTETRNTVSREELMMVLASL        1771
NOV1d              ------------------------------------------------------------           1
gi|7459688|pir|    SRPDVVLQGNQMSIAFLELAYPPPGQVHRGQLQLVEGNFRHLETHNPVSREELMMVLAGL        1708
gi|2497593|sp|Q    VAPDVILFSEHNALVHTSYEQPSRNEPFTNRVNIVESNFQTISGK-PVSRADFMMVLRDL        1732
gi|14786772|ref    ------------------------------------------------------------           1
gi|2281044|emb|    ------------------------------------------------------------           1
gi|17136292|ref    VAPDVILFSEHNALVHTSYEQPSRNEPFTNRVNIVESNFQTISGK-PVSRADFMMVLRDL        1732

1810       1820       1830       1840       1850       1860
                   ....|....|....|....|....|....|....|....|....|....|....|....|
NOV1a              EQLQIRALFSQISSAVFLRRVALEVASPAGQGA---LASNVELCLCPASYRGDSCQECAP        1831
NOV1b              ------------------------------------------------------------           1
NOV1c              EQLQIRALFSQISSAVFLRRVALEVASPAGQGA---LASNVELCLCPASYRGDSCQECAP        1828
NOV1d              ------------------------------------------------------------           1
gi|7459688|pir|    EQLQIRALFSQTSSSVSLRRVVLEVASEAGRGP---PASNVELCMCPANYRGDSCQECAP        1765
gi|2497593|sp|Q    KVIFIRANYWEQTLVTHLSDVYLTLADEDADGTGEYQFLAVERCSCPPGYSGHSCEDCAP        1792
gi|14786772|ref    ------------------------------------------------------------           1
gi|2281044|emb|    ------------------------------------------------------------           1
gi|17136292|ref    KVIFIRANYWEQTLVTHLSDVYLTLADEDADGTGEYQFLAVERCSCPPGYSGHSCEDCAP        1792

1870       1880       1890       1900       1910       1920
                   ....|....|....|....|....|....|....|....|....|....|....|....|
NOV1a              GFYRDVKGLFLGRCVPCQCHGHSDRCLPGSGVCV-CQHNTEGAHCERCQAGFV-SSRDDP        1889
NOV1b              ------------------------------------------------------------           1
NOV1c              GFYRDVKGLFLGRCVPCQCHGHSDRCLPGSGVCV-CQHNTEGAHCERCQAGFV-SSRDDP        1886
NOV1d              ------------------------------------------------------------           1
gi|7459688|pir|    GYYRDTKGLFLGRCVPCQCHGHSDRCLPGSGICVGCQHNTEGDQCERCRPGFVSSDPSNP        1825
gi|2497593|sp|Q    GYYRDPSGPYGGYCIPCECNGHSETCDCATGICSKCQHGTEGDHCERCVSGYYGNATNGT        1852
gi|14786772|ref    ------------------------------------------------------------           1
gi|2281044|emb|    ------------------------------------------------------------           1
gi|17136292|ref    GYYRDPSGPYGGYCIPCECNGHSETCDCATGICSKCQHGTEGDHCERCVSGYYGNATNGT        1852

1930       1940       1950       1960       1970       1980
                   ....|....|....|....|....|....|....|....|....|....|....|....|
NOV1a              SAPCVSCPCPLSVPSN----------------------------RCAPGFFGNPLVLGS        1920
NOV1b              ------------------------------------------------------------           1
NOV1c              SAPCVSCPCPLSVPSN----------------------------RCAPGFFGNPLVLGS        1917
NOV1d              ------------------------------------------------------------           1
gi|7459688|pir|    ASPCVSCPCPLAVPSNNFADGCVLRNG--RTQCLCRPGYAGASCERCAPGFFGNPLVLGS        1883
gi|2497593|sp|Q    PGDCMICACPLPFDSNNFATSCEISESGDQIHCECKPGYTGPRCESCANGFYGEPESIGQ        1912
gi|14786772|ref    ------------------------------------------------------------           1
gi|2281044|emb|    ------------------------------------------------------------           1
gi|17136292|ref    PGDCMICACPLPFDSNNFATSCEISESGDQIHCECKPGYTGPRCESCANGFYGEPESIGQ        1912
```

TABLE 1J-continued

ClustalW Analysis of NOV1

```
                          1990      2000      2010      2020      2030      2040
                      ....|....|....|....|....|....|....|....|....|....|....|....|
NOV1a                 SCQPCDCSGNGDPNLLFSDCDPLTGACRGCLRHTTGPRCEICAPGFYGNALLPGNCTRCD      1980
NOV1b                 ------------------------------------------------------------         1
NOV1c                 SCQPCDCSGNGDPNLLFSDCDPLTGACRGCLRHTTGPRCEICAPGFYGNALLPGNCTRCD      1977
NOV1d                 ------------------------------------------------------------         1
gi|7459688|pir|       SCQPCDCSGNGDPNMIFSDCDPLTGACRGCLRHTTGPHCERCAPGFYGNALLPGNCTRCD      1943
gi|2497593|sp|Q       VCKPCECSGNINPEDQGS-CDTRTGECLRCLNNTFGAACNLCAPGFYGDAIKLKNCQSCD      1971
gi|14786772|ref       ------------------------------------------------------------         1
gi|2281044|emb|       ------------------------------------------------------------         1
gi|17136292|ref       VCKPCECSGNINPEDQGS-CDTRTGECLRCLNNTFGAACNLCAPGFYGDAIKLKNCQSCD      1971

2050      2060      2070      2080      2090      2100
                      ....|....|....|....|....|....|....|....|....|....|....|....|
NOV1a                 CTPCGTEACDPHSGHCLCKAGVTGRRCDRCQEGHFGFDGCGGCRPCACGPAAEGSFCHEQ      2040
NOV1b                 ------------------------------------------------------------         1
NOV1c                 CTPCGTEACDPHSGHCLCKAGVTGRRCDRCQEGHFGFDGCGGCRPCACGPANEGSFCHEQ      2037
NOV1d                 --------------------------CDRCQEGHFGFNGCGGCRPCACGPAAKGSFCHEQ        34
gi|7459688|pir|       CSPCGTETCDPQSGRCLCKAGVTGQRCDRCLEGYFGFEQCQGCRPCACGPAAKGSQCHEQ      2003
gi|2497593|sp|Q       CDDLGTOTCDPFVGVCTCHENVIGDRCDRCKPDHYGFESGVGCRACDCGAASNSYQCDPH      2031
gi|14786772|ref       ---------------------------------------MAAGAAARVLVDRPPRAPSATER       23
gi|2281044|emb|       ------------------------------------------------------------         1
gi|17136292|ref       CDDLGTOTCDPFVGVCTCHENVIGDRCDRCKPDHYGFESGVGCRACDCGAASNSYQCDPH      2031

2110      2120      2130      2140      2150      2160
                      ....|....|....|....|....|....|....|....|....|....|....|....|
NOV1a                 SGQCHCRPGTMGPQCRECAPGYWGLPEQGCRRCQCPGGR-----CRPHTGRCNCPPGLSG      2095
NOV1b                 ------------------------------------------------------------         1
NOV1c                 SGQCHCRPGTMGPQCRECAPGYWGLPEQGCRRCQCPGGR-----CRPHTGRCNCPPGLSG      2092
NOV1d                 ------------------------------------------------------------         1
gi|7459688|pir|       SGQCHCQPGTTGPQCLECAPGYWGLPFKGCRRCQCPRGH-----CDPATGHCTCPPGLSG      2058
gi|2497593|sp|Q       TGHCACKSGVTGRQCDRCAVDHWKYEKDGCTPCNCNQGYSRGFGCNPNTGKCQCLPGVIG      2091
gi|14786772|ref       ADSATADQGPWDPSAASVPLATGGSLSRAAGAASALGAA-----VTLTRAAATAPRGSAG         1
gi|2281044|emb|       ------------------------------------------------------------         1
gi|17136292|ref       TGHCACKSGVTGRQCDRCAVDHWKYEKDGCTPCNCNQGYSRGFGCNPNTGKCQCLPGVIG      2091

2170      2180      2190      2200      2210      2220
                      ....|....|....|....|....|....|....|....|....|....|....|....|
NOV1a                 RRCDICSQQHQVPVPGGPVGHSIHCEVCDHCVVLLDDLERAGALEPATHEQLRGINASS       2155
NOV1b                 ------------------------------------------------------------         1
NOV1c                 RRCDICSQQHQVPVPGGPVGHSIHCEVCDHCVVLLDDLERAGALEPATHEQLRGINASS       2152
NOV1d                 RRCDICSQQHQVPVPGGPVGHSIHCEVCDHCVVLLDDLERAGALEPATHEQLRGINASS        149
gi|7459688|pir|       RRCDICSQQHQVPVPGPGGHGIHCEVCDHCVVLLDDLERAGALEPATREQLQGINASS       2118
gi|2497593|sp|Q       DRCDACPNRWVEIKDEG-------CGECNNCHHALLDVTDRMRYQIDSVLEDFNSVTLAF      2144
gi|14786772|ref       SAATPAASSIRCLFQAGLWATASTVKVCDHCVVLLDDLERAGALEPATHEQLRGINASS        138
gi|2281044|emb|       ------------------------------------------------------------         1
gi|17136292|ref       DRCDACPNRWVEIKDEG-------CGECNNCHHALLDVTDRMRYQIDSVLEDFNSVTLAF      2144

2230      2240      2250      2260      2270      2280
                      ....|....|....|....|....|....|....|....|....|....|....|....|
NOV1a                 MAWARLRRLNASIARLQVLSVLAFPPQPGVQAFTFRLPQSQLRSPLGPRHETAQQLEVL       2215
NOV1b                 ------------------------------------------------------------         1
NOV1c                 MAWARLRRLNASIARLQVLSVLAFPPQPGVQAFTFRLPQSQLRSPLGPRHETAQQLEVL       2212
NOV1d                 MAWARLRRLNASIARL----------------------QSQLRSPLGPRHETAQQLEVL        186
gi|7459688|pir|       AAWARLRRLNASIADL----------------------QSKLRSPPGPRYQAAQQLQTL       2155
gi|2497593|sp|Q       FTSQRLNYYDQLADSLEP--------------------KVKLLDE------NSVDLSPS       2177
gi|14786772|ref       MAWARLRRLNASIARL----------------------QSQLRSPLGPRHETAQQLEVL        175
gi|2281044|emb|       ------------------------------------------------------------         1
gi|17136292|ref       FTSQRLNYYDQLADSLEP--------------------KVKLLDE------NSVDLSPS       2177

2290      2300      2310      2320      2330      2340
                      ....|....|....|....|....|....|....|....|....|....|....|....|
NOV1a                 EQQSISLPP-------QAVGTRDQASQLLAGTEALLGHAKTLLAAIRAVDRTLSELMSQT      2268
NOV1b                 ------------------------------------------------------------         1
NOV1c                 EQQSISLPP-------QAVGTRDQASQLLAGTEALLGHAKTLLAAIRAVDRTLSELMSQT      2265
NOV1d                 EQQSISLGQDARRLGGQAVGTRDQASQLLAGTEALLGHAKTLLAAIRAVDRTLSELMSQT       246
gi|7459688|pir|       EQQSISLQQDTERLGSQATGQGQAGQELDTTESTLGRAQKLLESVRAVGRALNELASRM      2215
gi|2497593|sp|Q       KKANSELESDAKSYAKQVNQTLANAFDIRERSSTTLGNITVAYDEAVKSADQAKEAPASV      2237
gi|14786772|ref       EQQSISLGQDARRLGGQAVGTRDQASQLLAGTEALLGHAKTLLAAIRAVDRTLSELMSQT       235
gi|2281044|emb|       ------------------------------------------------------------         1
gi|17136292|ref       KKANSELESDAKSYAKQVNQTLANAFDIRERSSTTLGNITVAYDEAVKSADQAKEAMASV      2237
```

TABLE 1J-continued

ClustalW Analysis of NOV1

```
                         2350       2360       2370       2380       2390       2400
                    ....|....|....|....|....|....|....|....|....|....|....|....|
NOV1a               GHLGLANASAPSGEQLLRTLAEVERLLWEMRARDLGAPQAAAEAELAAAQRVLARVQEQL      2328
NOV1b               ------------------------------------------------------------         1
NOV1c               GHLGLANASAPSGEQLLRTLAEVERLLWEMRARDLGAPQAAAEAELAAAQRVLARVQEQL      2325
NOV1d               GHLGLANASAPSGEQLLRTLAEVERLLWEMRARDLGAPQAAAEAELAAAQRVLARVQEQL       306
gi|7459688|pir|     GQGSPGQALVPSGEQLRWALAVERRLLWDMRTRDLGAQGAVAEAELAEAQRLMARVQEQL      2275
gi|2497593|sp|Q     EALS-KNLEAAASTKIDAALEKAEHLLGQING--TSIELTPNEQVLEKARKLYEEVNTLV      2294
gi|14786772|ref     GHLGLANASAPSGEQLLRTLAEVERLLWEMRARDLGAPQAAAEAELAAAQRLLARVQEQL       295
gi|2281044|emb|     ------------------------------------------------------------         1
gi|17136292|ref     EALS-KNLEAAASTKIDAALEKAEHLLGQING--TSIELTPNEQVLEKARKLYEEVNTLV      2294

2410       2420       2430       2440       2450       2460
                    ....|....|....|....|....|....|....|....|....|....|....|....|
NOV1a               SSLWEENQALATQTRDR--LAQHEAGLMDLREALNRAVDATREAQELNSRNQERLEEALQ      2386
NOV1b               ------------------------------------------------------------         1
NOV1c               SSLWEENQALATQTRDR--LAQHEAGLMDLREALNRAVDATREAQELNSRNQERLEEALQ      2383
NOV1d               SSLWEENQALATQTRDR--LAQHEAGLMDLREALNRAVDATREAQELNSRNQERLEEALQ       364
gi|7459688|pir|     TSLWEENQALATHIRDQ--LAQVESGLMDLREALNQAVNTTREAEELNSRNQERVKEALQ      2333
gi|2497593|sp|Q     LPIKAQNKSLNALKNDIGEFSDHLEDLFNWSEASQAKSADVERRNVANQKAFLNSKFDTV      2354
gi|14786772|ref     SSLWEENQALATQTRDR--LAQHEAGLMDLREALNRAVDATREAQELNSRNQERLEEALQ       353
gi|2281044|emb|     ------------------------------------------------------------         1
gi|17136292|ref     LPIKAQNKSLNALKNDIGEFSDHLEDLFNWSEASQAKSADVERRNVANQKAFLNSKFDTV      2354

2470       2480       2490       2500       2510       2520
                    ....|....|....|....|....|....|....|....|....|....|....|....|
NOV1a               RKQELSRDNATLQATLHAARDTLASVFRLLEGLSPLKFQELERLAASLDGARTPLLQRMQ      2446
NOV1b               ------------------------------------------------------------         1
NOV1c               RKQELSRDNATLQATLHAARDTLASVFRLLEGLSPLKFQELERLAASLDGARTPLLQRMQ      2443
NOV1d               RKQELSRDNATLQATLHAARDTLASVFRLLHSLDQAK-EELERLAASLDGARTPLLQRMQ       423
gi|7459688|pir|     WKQELSQDNATLKATLQAASLILGHVSELEQGIDQAK-EDLEHLAASLDGAWTPLLKRMQ      2392
gi|2497593|sp|Q     SEQKLQAEKNIKDAGNFLINGDIT-LNQIQKLDNLR-DALNELNSFNKNVDEELPVRED      2412
gi|14786772|ref     RKQELSRDNATLQATLHAARDTLASVFRLLHSLDQAK-EELERLAASLDGARTPLLQRMQ       412
gi|2281044|emb|     ------------------------------------------------------------         1
gi|17136292|ref     SEQKLQAEKNIKDAGNFLINGDIT-LNQIQKLDNLR-DALNELNSFNKNVDEELPVRED      2412

2530       2540       2550       2560       2570       2580
                    ....|....|....|....|....|....|....|....|....|....|....|....|
NOV1a               TFSPAGSKLRLVEAAEAHAQQLGQLALNLS-IILDVNQDRLTQRAIKASNAYSRLKQAVQ      2505
NOV1b               ------------------------------------------------------------         1
NOV1c               TFSPAGSKLRLVEAAEAHAQQLGQLALNLS-IILDVNQDRLTQRAIKASNAYSRLKQAVQ      2502
NOV1d               TFSPAGSKLRLVEAAEAHAQQLGQLALNLSSIILDVNQDRLTQRAIKASNAYSRLKQAVQ       483
gi|7459688|pir|     AFSPASSKVDLVEAAEAHAQKLNQLAINDSGIILLNQDRFIQRAVEASNAYSSILQAVQ      2452
gi|2497593|sp|Q     QHKEAD---ALTEQAEQKAAELAIKAQDLAAQYTDMTAS--AEPATKAATAYSGIVEAVK      2467
gi|14786772|ref     TFSPAGSKLRLVEAAEAHAQQLGQLALNLSSIILDVNQDRLTQRAIKASNAYSRLKQAVQ       472
gi|2281044|emb|     ------------------------------------------------------------         1
gi|17136292|ref     QHKEAD---ALTEQAEQKAAELAIKAQDLAAQYTDMTAS--ASPATKAATAYSGIVEAVK      2467

2590       2600       2610       2620       2630       2640
                    ....|....|....|....|....|....|....|....|....|....|....|....|
NOV1a               AAEDAAGQALQQADRTWQIVVRQGLVDRAQQLLANSTALEEAMLQEQQRLGLGECWAPMG      2565
NOV1b               ------------------------------------------------------------         1
NOV1c               AAEDAAGQALQQADRTWQIVVRQGLVDRAQQLLANSTALEEAMLQEQQRLGLGECWAPMG      2562
NOV1d               AAEDAAGQALQQADRTWAIVVRQGLVDRAQQLLAMSTALEEAMLQEQQRLGL--VWA---       538
gi|7459688|pir|     AAEDAAGQALRQASRTWEMVVRQGEAAGARQLLANSSALEETILGHQGRLGLA---QG--      2507
gi|2497593|sp|Q     AAQKLEQDAISAAGN--ATDKTDGEERAHLADTGSTDLLQRARQSLQKVQD----DLEP      2521
gi|14786772|ref     AAEDAAGQALQQADRTWAIVVRQGLVDRAQQLLAMSTALEEAMLQEQQRLGL--VWA---       527
gi|2281044|emb|     ------------------------------------------------------------         1
gi|17136292|ref     AARKLEQDAISAAGN--ATDKTDGEERAHLADTGSTDLLQRARQSLQKVQD----DLEP      2521

2650       2660       2670       2680       2690       2700
                    ....|....|....|....|....|....|....|....|....|....|....|....|
NOV1a               ALRPAGTQLRDVRAKKDQLEAHIQAAQAMLAMDTGEIS-KKIAHAKAVAEAQETATRVQ       2624
NOV1b               ------------------------------------------------------------         1
NOV1c               ALRPAGTQLRDVRAKKDQLEAHIQAAQAMLAMDTGEIS-KKIAHAKAVAEAQETATRVQ       2621
NOV1d               ALQGARTQLRDVRAKKDQLEAHIQAAQAMLAMDTGEIS-KKIAHAKAVAEAQETATRVQ        597
gi|7459688|pir|     RLQAAGIQLHNVWARKNQLAAQIQEAQAMEQEMAMTSETS-EKIAHAKAVAEALSTATHVQ      2566
gi|2497593|sp|Q     RLNASAGKVQKISAVNNATEHQLEKDINKEIDQLPAESQRDMWKNSNANASSALEILKNVL      2581
gi|14786772|ref     ALRPAGTQLRDVRAKKDQLEAHIQAAQAMLAMDTGEIS-KKIAHAKAVAEAQETATRVQ        586
gi|2281044|emb|     ------------------------------------------------------------         1
gi|17136292|ref     RLNASAGKVQKISAVNNATEHQLKKDINKEIDQLPAESQRDMWKNSNANASSALKILKNVL      2581
```

TABLE 1J-continued

ClustalW Analysis of NOV1

```
                     2710      2720      2730      2740      2750      2760
                ....|....|....|....|....|....|....|....|....|....|....|....|
NOV1a           SQLQAMQENVERWQGQYEGK-RGQDLG-QAVLDAGSAVSTLEKTLPQLLAKLSILPNR--    2680
NOV1b           ------------------------------------------------------------       1
NOV1c           SQLQAMQENVERWQGQYEGK-RGQDLG-QAVLDAGSAVSTLEKTLPQLLAKLSILPNR--    2677
NOV1d           SQLQAMQENVERWQGQYEGK-RGQDLG-QAVLDAHSAVSTLEKTLPQLLAKLSILPNR--     653
gi|7459688|pir| SQLQGMQKNVERWQSQLGGK-QGQDLS-QVIRDASSSVSTLEKTLPELLAKLSREENR--    2622
gi|2497593|sp|Q EILEPVSVQTPKELEKAHGENRDLDLTNKDVSQANKQLDDVEGSVSKLNELAEDLEEQQH    2641
gi|14786772|ref SQLQAMQENVERWQGQYEGK-RGQDLG-QAVLDAGSAVSTLEKTLPQLLAKLSILPNR--     642
gi|2281044|emb| ------------------------------------------------------------       1
gi|17136292|ref EILEPVSVQTPKELEKAHGENRDLDLTNKDVSQANKQLDDVEGSVSKLNELAEDLEEQQH    2641

2770      2780      2790      2800      2810      2820
                ....|....|....|....|....|....|....|....|....|....|....|....|
NOV1a           GVHNASLALSASIGRVRELLAQARGAASKVWKVPMKFNGRSGVQLRTPRDLADLAAYTAL    2740
NOV1b           ------------------------------------------------------------       1
NOV1c           GVHNASLALSASIGRVRELLAQARGAASKVWKVPMKFNGRSGVQLRTPRDLADLAAYTAL    2737
NOV1d           GVHNASLALSASIGRVRELLAQARGAASK-WKVPMKFNGRSGVQLRTPRDLADLAAYTAL     712
gi|7459688|pir| GVHNASLALSANIGRVKLLAQARSASK-WKVSWKFNGRSGVQLRPPRDLADLAAYTAL     2681
gi|2497593|sp|Q RVGSQSRQLGQEIENLKAQVEAARQLAWS-WKVGWNFKPSTIEELKTPEKTKLLATRTNL    2700
gi|14786772|ref GVHNASLALSASIGRVRELLAQARGAASK-WKVPMKFNGRSGVQLRTPRDLADLAAYTAL     701
gi|2281044|emb| --------------------------------------SGVQLRTPRDLADLAAYTAL      20
gi|17136292|ref RVGSQSRQLGQEIENLKAQVEAARQLAWS-WKVGWNFKPATIEELKTPEKTKLLATRTNL    2700

2830      2840      2850      2860      2870      2880
                ....|....|....|....|....|....|....|....|....|....|....|....|
NOV1a           KFYXQG--PEPEPGQGTEDRFVMYMGSRQATG----DYMGVSLRDKKVHWVVQLGEAGPA    2794
NOV1b           -------------------MYMGSRQATG----DYMGVSLRDKKVHWVVQLGEAGPA      34
NOV1c           KFYXQG--PEPEPGQGTEDRFVMYMGSRQATG----DYMGVSLRDKKVHWVVQLGEAGPA    2791
NOV1d           KFYXQG--PEPEPGQGTEDRFVMYMGSRQATG----DYMGVSLRDKKVHWVVQLGEAGPA     766
gi|7459688|pir| KFXXQGPVPAPEPGXNTGDXFVXYMGSRQATG----DYMGVSLRXKVHVYXLGXAGPT    2737
gi|2497593|sp|Q STYFRT-----TEP---SGFXXYXGXDNKTXQKNNDXXAVEXXVXGYPILTIDLGNGPER    2751
gi|14786772|ref KFYXQG--PEPEPGQGTEDRFVMYMGSRQATG----DYMGVSLRDKKVHWVVQLGEAGPA     755
gi|2281044|emb| KFYXQG--PEPEPGQGTEDRFVMYMGSRQATG----DYMGVSLRDKKVHWVVQLGEAGPA      74
gi|17136292|ref STYFRT-----TEP---SGFXXYXGXDNKTAQKNNDXXAVEXXVNGYPILTIDLGNGPER    2751

2890      2900      2910      2920      2930      2940
                ....|....|....|....|....|....|....|....|....|....|....|....|
NOV1a           VLSIDEDIGEQFAAVSLDRTLQFGHMSVTVER--QMIQETKGDTVAPGAEGLLNLRPDDS    2852
NOV1b           VLSIDEDIGEQFAAVSLDRTLQFGHMSVTVER--QMIQETKGDTVAPGAEGLLNLRPDDS      92
NOV1c           VLSIDEDIGEQFAAVSLDRTLQFGHMSVTVER--QMIQETKGDTVAPGAEGLLNLRPDDS    2849
NOV1d           VLSIDEDIGEQFAAVSLDRTLQFGHMSVTVER--QMIQETKGDTVAPGAEGLLNLRPDDS     824
gi|7459688|pir| TLSIDENIGEQFAAVSLDRTLQFGHMSVTVEK--QMXHEIKGDTVAPGXEGLLNLHPDDS    2795
gi|2497593|sp|Q XTSDKYVADGRXYQAVVDRMGPNAKXXXREELPNGDXVEHSKSGYLEGSXQNXLXXD-KNS    2810
gi|14786772|ref VLSIDEDIGEQFAAVSLDRTLQFGHMSVTVER--QMIQETKGDTVAPGAEGLLNLRPDDS     813
gi|2281044|emb| VLSIDEDIGEQFAAVSLDRTLQFGHMSVTVER--QMIQETKGDTVAPGAEGLLNLRPDDS     132
gi|17136292|ref XTSDKYVADGRXYQAVVDRMGPNAKXXXREELPNGDXVEHSKSGYLEGSXQNXLXXD-KNS    2810

2950      2960      2970      2980      2990      3000
                ....|....|....|....|....|....|....|....|....|....|....|....|
NOV1a           VFYVGGYP--STFTPPPLLRFPGYRGCIEMDTLNEEVVSLYNFERTFQLDTAVDRPCARS    2910
NOV1b           VFYVGGYP--STFTPPPLLRFPGYRGCIEMDTLNEEVVSLYNFERTFQLDTAVDRPCARS     150
NOV1c           VFYVGGYP--STFTPPPLLRFPGYRGCIEMDTLNEEVVSLYNFERTFQLDTAVDRPCARS    2907
NOV1d           VFYVGGYP--STFTPPPLLRFPGYRGCIEMDTLNEEVVSLYNFERTFQLDTAVDRPCARS     882
gi|7459688|pir| VFYVGGYP--SNFTPPEELRFPGYLGCIEMSTLNEEVVSLYNFE TF LDTAVD PCARS    2853
gi|2497593|sp|Q RLEVGGYPGISDFNAPPDLTTNSXSCDIEDLKXGXESVGLXNFVYGDDNDQGARE---RD    2867
gi|14786772|ref VFYVGGYP--STFTPPPLLRFPGYRGCIEMDTLNEEVVSLYNFERTFQLDTAVDRPCARS     871
gi|2281044|emb| VFYVGGYP--STFTPPPLLRFPGYRGCIEMDTLNEEVVSLYNFERTFQLDTAVDRPCARS     190
gi|17136292|ref RLEVGGYPGISDFNAPPDLTTNSXSCDIEDLKXGXESVGLXNFVYGDDNDQGARE---RD    2867

3010      3020      3030      3040      3050      3060
                ....|....|....|....|....|....|....|....|....|....|....|....|
NOV1a           KSTGDPWLTDGSYLDGTGFARISFDSQIS--TTKRFEQELRLVSYSGVLFFLKQQSQFLQ    2968
NOV1b           KSTGDPWLTDGSYLDGTGFARISFDSQIS--TTKRFEQELRLVSYSGVLFFLKQQSQFLQ     208
NOV1c           KSTGDPWLTDGSYLDGTGFARISFDSQIS--TTKRFEQELRLVSYSGVLFFLKQQSQFLQ    2965
NOV1d           KSTGDPWLTDGSYLDGTGFARISFDSQIS--TTKRFEQELRLVSYSGVLFFLKQQSQFLQ     940
gi|7459688|pir| KXTGDPWLTDGSYLDGTGFXARISFDSQFS--NTKRFXQELRLVSYNGXXFFLKQXSQFLQ    2911
gi|2497593|sp|Q VLLEKKKPVTGLRFKGNGXVQLXATSNXKSRSSIQXSXKADKDXSXGLXFFYGRDKHXXS    2927
gi|14786772|ref KSTGDPWLTDGSYLDGTGFARISFDSQIS--TTKRFEQELRLVSYSGVLFFLKQQSQFLQ     929
gi|2281044|emb| KSTGDPWLTDGSYLDGTGFARISFDSQIS--TTKRFEQELRLVSYSGVLFFLKQQSQFLQ     248
gi|17136292|ref VLLEKKKPVTGLRFKGNGXVQLXATSNXKSRSSIQXSXKADKDXSXGLXFFYGRDKHXXS    2927
```

TABLE 1J-continued

ClustalW Analysis of NOV1

```
                           3070       3080       3090       3100       3110       3120
                     ....|....|....|....|....|....|....|....|....|....|....|....|
NOV1a                LAVQEGSLVLLYDFGAGLKKAVPLQPPPPLTSASKAIQVFLLGGSRKRVLVRVERATVYS      3028
NOV1b                LAVQEGSLVLLYDFGAGLKKAVPLQPPPPLTSASKAIQVFLLGGSRKRVLVRVERATVYS       268
NOV1c                LAVQEGSLVLLYDFGAGLKKAVPLQPPPPLTSASKAIQVFLLGGSRKRVLVRVERATVYS      3025
NOV1d                LAVQEGSLVLLYDFGAGLKKAVPLQPPPPLTSASKAIQVFLLGGSRKRVLVRVERATVYS      1000
gi|7459688|pir|      LAVQEGSLVLFYDFGSGLKKADPLQPPQALTSASKAIQVFLLAGSRKRVLVRVERATVES      2971
gi|2497593|sp|Q      KEMIDGAIFFNISLGEGGGVQSGSQDRYNDNQWHKVQAERENRNGLLKVDDIVISRLNAP      2987
gi|14786772|ref      LAVQEGSLVLLYDFGAGLKKAVPLQPPPPLTSASKAIQVFLLGGSRKRVLVRVERATVYS       989
gi|2281044|emb|      LAVQEGSLVLLYDFGAGLKKAVPLQPPPPLTSASKAIQVFLLGGSRKRVLVRVERATVYS       308
gi|17136292|ref      KEMIDGAIFFNISLGEGGGVQSGSQDRYNDNQWHKVQAERENRNGLLKVDDIVISRLNAP      2987

3130       3140       3150       3160       3170       3180
                     ....|....|....|....|....|....|....|....|....|....|....|....|
NOV1a                VEQDNDLELADAYYLGGVPPDQLP-SLRRLFPTGGSVRGCVKGIKALGKYVDLKRLNTTG      3087
NOV1b                VEQDNDLELADAYYLGGVPPDQLP-SLRWLFPTGGSVRGCVKGIKALGKYVDLKRLNTTG       328
NOV1c                VEQDNDLELADAYYLGGVPPDQLP-SLRRLFPTGGSVRGCVKGIKALGKYVDLKRLNTTG      3084
NOV1d                VEQDNDLELADAYYLGGVPPDQLPPSLRWLFPTGGSVRGCVKGIKALGKYVDLKRLNTTG      1060
gi|7459688|pir|      VEQDNMLEMADAYYLGGVPPDQLPLSLRLFPSGGSVRGCKKGIKALGKYVDLKRLNTTG      3031
gi|2497593|sp|Q      KEADLELPKLRRLYFGGHPR-----RLNTSISLQPNFDGCEDNKVINQGVVDLTEYVTGG      3042
gi|14786772|ref      VEQDNDLELADAYYLGGVPPDQLP-SLRRLFPTGGSVRGCVKGIKALGKYVDLKRLNTTG      1049
gi|2281044|emb|      VEQDNDLELADAYYLGGVPPDQLP-SLRWLFPTGGSVRGCVKGIKALGKYVDLKRLNTTG       368
gi|17136292|ref      KEADLELPKLRRLYFGGHPR-----RLNTSISLQPNFDGCEDNKVINQGVVDLTEYVTGG      3042

3190       3200       3210       3220       3230       3240
                     ....|....|....|....|....|....|....|....|....|....|....|....|
NOV1a                -VSAGCTADLLVGRAMTFHGHGFLRLALSNVAPLTGNVYSGFGFHSAQDSALLYYRASPV      3146
NOV1b                -VSAGCTADLLVGRAMTFHGHGFLRLALSNVAPLTGNVYSGFGFHSAQDSALLYYRASPD       387
NOV1c                -VSAGCTADLLVGRAMTFHGHGFLRLALSNVAPLTGNVYSGFGFHSAQDSALLYYRASPV      3143
NOV1d                -VSAGCTADLLVGRAMTFHGHGFLRLALSNVAPLTGNVYSGFGFHSAQDSALLYYRASPD      1119
gi|7459688|pir|      -KSFGCTADLLVGRIMTFHGHGFLPLALPDVAPKTEVVYSGFGFRGTQDNNLLYYRISPD      3090
gi|2497593|sp|Q      GVEEGCSAKFSTVVSYAPHEYGFLRMNN----VSSDNNKKVVLHFKETQPNGVLRYAANHD      3099
gi|14786772|ref      -VSAGCTADLLVGRAMTFHGHGFLRLALSNVAPLTGNVYSGFGFHSAQDSALLYYRASPD      1108
gi|2281044|emb|      -VSAGCTADLLVGRAMTFHGHGFLRLALSNVAPLTGNVYSGFGFHSAQDSALLYYRASPD       427
gi|17136292|ref      GVEEGCSAKFSTVVSYAPHEYGFLRMNN----VSSDNNKKVVLHFKETQPNGVLRYAANHD      3099

3250       3260       3270       3280       3290       3300
                     ....|....|....|....|....|....|....|....|....|....|....|....|
NOV1a                --RPHQVSLQQGRVSLQLLRTEVKTQAGFADGAPHYVAFYSNATGVWLYVDDQLQQMKPH      3204
NOV1b                --GLQQVSLQQGRVSLQLLRTEVKTQAGFADGAPHYVAFYSNATGVWLYVDDQLQQMKPH       445
NOV1c                --RPHQVSLQQGRVSLQLLRTEVKTQAGFADGAPHYVAFYSNATGVWLYVDDQLQQMKPH      3201
NOV1d                --GLQQVSLQQGRVSLQLLRTEVKTQAGFADGAPHYVAFYSNATGVWLYVDDQLQQMKPH      1177
gi|7459688|pir|      --GPYQVSLREGHVBLRFMNQEVETQRVFADGAPHYVAFYSNVTGVWLYVDDQLQLVKSH      3148
gi|2497593|sp|Q      QSSTIGESLQDGLEKLNSMGSKKEVIDDRILNDGEGHVVTQHTQGELRLTVDDVDNKRLG      3159
gi|14786772|ref      --GLCQVSLREGHVTLRFMNQEVETQRVFADGAPHYVAFYSNVTGVWLYVDDQLQVKSH      1166
gi|2281044|emb|      --GLCQVSLREGHVTLRFMNQEVETQRVFADGAPHYVAFYSNVTGVWLYVDDQLQLVKSH       485
gi|17136292|ref      QSSTIGESLQDGLEKLNSMGSKKEVIDDRILNDGEGHVVTQHTQGELRLTVDDVDNKRLG      3159

3310       3320       3330       3340       3350       3360
                     ....|....|....|....|....|....|....|....|....|....|....|....|
NOV1a                RGPPPELQPQ---PEGPPRLLLGGLPESGTIYNFSGCISNVFVQRLLG-------------      3249
NOV1b                RGPPPELQPQ---PEGPPRLLLGGLPESGTIYNFSGCISNVFVQRLLG-------------       490
NOV1c                RGPPPELQPQ---PEGPPRLLLGGLPESGTIYNFSGCISNVFVQRLLG-------------      3246
NOV1d                RGPPPELQPQ---PEGPPRLLLGGLPESGTIYNFSGCISNVFVQRLLG-------------      1222
gi|7459688|pir|      ERTTPMLQLQ---PEEPSRLLLGGLPVSGTFHNFSGCISNVFVQRLRG-------------      3193
gi|2497593|sp|Q      SPQELILEGGDIFFAGLPDNYRTPRNALAKKAYFVGCISEVTVNEEEINFANSAEKKNGN      3219
gi|14786772|ref      RGPPPELQPQ---PEGPPRLLLGGLPESGTIYNFSGCISNVFVQRLLG-------------      1211
gi|2281044|emb|      RGPPPELQPQ---PEGPPRLLLGGLPESGTIYNFSGCISNVFVQRLLG-------------       530
gi|17136292|ref      SPQELILEGGDIFFAGLPDNYRTPRNALAKKAYFVGCISEVTVNEEEINFANSAEKKNGN      3219

3370       3380       3390       3400       3410       3420
                     ....|....|....|....|....|....|....|....|....|....|....|....|
NOV1a                ----PQRVFDLQQNLGSVNVSTG------------------------CAPALQAQTPGLG      3281
NOV1b                ----PQRVFDLQQNLGSVNVSTG------------------------CAPALQAQTPGLG       522
NOV1c                ----PQRVFDLQQNLGSVNVSTG------------------------CAPALQAQTPGLG      3278
NOV1d                ----PQRVFDLQQNLGSVNVSTG------------------------CAPALQAQTPGLG      1254
gi|7459688|pir|      ----PQRVFDLHQNMGSVNVSVG------------------------CTPAQLIETS---      3222
gi|2497593|sp|Q      INGCPPHVLAYEPSLVPSYYPSGDNENESPWSNADTLPPLKPDIESTLPETTPTTITTTT      3279
gi|14786772|ref      ----PQRVFDLQQNLGSVNVSTG------------------------CAPALQAQTPGLG      1243
gi|2281044|emb|      ----PQRVFDLQQNLGSVNVSTG------------------------CAPALQAQTPGLG       561
gi|17136292|ref      INGCPPHVLAYEPSLVPSYYPSGDNENESPWSNADTLPPLKPDIESTLPETTPTTITTTT      3279
```

TABLE 1J-continued

ClustalW Analysis of NOV1

```
                          3430      3440      3450      3460      3470      3480
                     ....|....|....|....|....|....|....|....|....|....|....|....|
NOV1a                PR---Q----ASRRSRQPA-----------------------------RHPACMLP---   3301
NOV1b                PRGLQATARKASRRSRQPA-----------------------------RHPACMLP---    549
NOV1c                PR---Q----ASRRSRQPA-----------------------------RHPACMLP---   3298
NOV1d                PRGLQATARKASRRSRQPA-----------------------------RHPACMLP---   1281
gi|7459688|pir|      -R---ATAQKVSRRSRQPS-----------------------------EDLACTTP---   3245
gi|2497593|sp|Q      TTTTSTTTTSTTTTTTPSPIVIDEEKEIEAKTPQKILTTRPPAKLNLPSDERCKLPEQP   3339
gi|14786772|ref      PRGLQATARKASRRSRQPA-----------------------------RHPACMLP---   1270
gi|2281044|emb|      PRGLQATARKASRRSRQPA-----------------------------RHPACMLP---    589
gi|17136292|ref      TTTTSTTTTSTTTTTTPSPIVIDEEKEIEAKTPQKILTTRPPAKLNLPSDERCKLPEQP   3339

3490      3500      3510      3520      3530      3540
                     ....|....|....|....|....|....|....|....|....|....|....|....|
NOV1a                -PHLRTTRDSYQFGGSLSSHLEFVGILARHR---------N-------------------   3332
NOV1b                -PHLRTTRDSYQFGGSLSSHLEFVGILARHRNWPSLSMHVLPRSS-RGLLSETARLSPGS    607
NOV1c                -PHLRTTRDSYQFGGSLSSHLEFVGILARHR---------N-------------------   3329
NOV1d                -PHLRTTRDSYQFGGSLSSHLEFVGILARHRNWPSLSMHVLPRSS-RGLLSETARLSPGS   1339
gi|7459688|pir|      -WLPGIIQDSYQFGGPLPSYLGFSISPSHRNRLHLSMLVRPHAASQGLLSSTAPMSGRS   3304
gi|2497593|sp|Q      NFDVDFTEAGYRFYCLREQRLQINSIPVEVRRHHDIGISFRTERP-NGLLTLAGSKQRDD   3398
gi|14786772|ref      -PHLRTTRDSYQFGGSLSSHLEFVGILARHRNWPSLSMHVLPRSS-RGLLSETARLSPGS   1328
gi|2281044|emb|      -PHLRTTRDSYQFGGSLSSHLEFVGILARHRNWPSLSMHVLPRSS-RGLLSETARLSPGS    648
gi|17136292|ref      NFDVDFTEAGYRFYCLREQRLQINSIPVEVRRHHDIGISFRTERP-NGLLTLAGSKQRDD   3398

3550      3560      3570      3580      3590      3600
                     ....|....|....|....|....|....|....|....|....|....|....|....|
NOV1a                ------------------------------------VSVRWEENRILLVTDGARAWSQ   3354
NOV1b                PSLALFLSNGHFVAQMEGLGTRLRAQSRQRSRPGRWHKVSVRWEENRILLVTDGARAWSQ    667
NOV1c                ------------------------------------VSVRWEENRILLVTDGARAWSQ   3351
NOV1d                PSLALFLSNGHFVAQMEGLGTRLRAQSRQRSRPGRWHKVSVRWEENRILLVTDGARAWSQ   1399
gi|7459688|pir|      PSLVLFLNHGHFVAQTECPGPRLQVQSRQHSRACQWHRVSVRWGMQSIQLVVDGSQTWSA   3364
gi|2497593|sp|Q      FIAVYLLDGRVTYEIRVCAQLQAKITTEAELNDCTWHTVEVVRTQRKVSLEIDKLEQPGS   3458
gi|14786772|ref      PSLALFLSNGHFVAQMEGLGTRLRAQSRQRSRPGRWHKVSVRWEENRILLVTDGARAWSQ   1388
gi|2281044|emb|      PSLALFLSNGHFVAQMEGLGTRLRAQSRQRSRPGRWHKVSVRWEENRILLVTDGARAWSQ    707
gi|17136292|ref      FIAVYLLDGRVTYEIRVCAQLQAKITTEAELNDCTWHTVEVVRTQRKVSLEIDKLEQPGS   3458

3610      3620      3630      3640      3650      3660
                     ....|....|....|....|....|....|....|....|....|....|....|....|
NOV1a                EGPHRQHQGAEHPQPHTLFVGGLPASSHSSKLPVTVG------FSGCVKRLRLHGRPLGA   3408
NOV1b                EGPHRQHQGAEHPQPHTLFVGGLPASSHSSKLPVTVG------FSGCVKRLRLHGRPLGA    721
NOV1c                EGPHRQHQGAEHPQPHTLFVGGLPASSHSSKLPVTVG------FSGCVKRLRLHGRPLGA   3405
NOV1d                EGPHRQHQGAEHPQPHTLFVGGLPASSHSSKLPVTVG------FSGCVKRLRLHGRPLGA   1453
gi|7459688|pir|      EALHHRVPRAERPQPSTLSVGGLPASSYSSKLPVSVG------FSGCIKRLSLDKKPLRT   3418
gi|2497593|sp|Q      VDLNAERSAPVLAVELPIIKGCVNKFLESEVKNSIDFKTEVPYFNCGEKNTKFDAMDLET   3518
gi|14786772|ref      EGPHRQHQGAEHPQPHTLFVGGLPASSHSSKLPVTVG------FSGCVKRLRLHGRPLGA   1442
gi|2281044|emb|      EGPHRQHQGAEHPQPHTLFVGGLPASSHSSKLPVTVG------FSGCVKRLRLHGRPLGA    761
gi|17136292|ref      VDLNAERSAPVLAVELPIIKGCVNKFLESEVKNSIDFKTEVPYFNCGEKNTKFDAMDLET   3518

3670      3680      3690      3700      3710      3720
                     ....|....|....|....|....|....|....|....|....|....|....|....|
NOV1a                PTRMAGVTPCILGPLEAGLFFPGSGGVITLGLPGATLPDVGLELEVRPLAVTGLIFHLGQ   3468
NOV1b                PTRMAGVTPCILGPLEAGLFFPGSGGVITLDLPGATLPDVGLELEVRPLAVTGLIFHLGQ    781
NOV1c                PTRMAGVTPCILGPLEAGLFFPGSGGVITLGLPGATLPDVGLELEVRPLAVTGLIFHLGQ   3465
NOV1d                PTRMAGVTPCILGPLEAGLFFPGSGGVITLDLPGATLPDVGLELEVRPLAVTGLIFHLGQ   1513
gi|7459688|pir|      PTSVGVTPCKSGPLEDGLFFPGSEGVITLELPKAKMPYVSLELERRPLAAAGLIFHLGQ   3577
gi|2497593|sp|Q      PPEEFGVVPCS-EQNERGLFFNNQKAFVKEFDHFDVGTEMKISFEKRPRDPNGLEPSVHG   1502
gi|14786772|ref      PTRMAGVTPCILGPLEAGLFFPGSGGVITLDLPGATLPDVGLELEVRPLAVTGLIFHLGQ    821
gi|2281044|emb|      PTRMAGVTPCILGPLEAGLFFPGSGGVITLDLPGATLPDVGLELEVRPLAVTGLIFHLGQ   3577
gi|17136292|ref      PPEEFGVVPCS-EQNERGLFFNNQKAFVKEFDHFDVGTEMKISFEKRPRDPNGLEPSVHG   1502

3730      3740      3750      3760      3770      3780
                     ....|....|....|....|....|....|....|....|....|....|....|....|
NOV1a                ARTPPYLQLQVLPRQVLLRADDGAGEFSTSVTRPS--VLCDGQWHRLAVMKSGNVLRLEV   3526
NOV1b                ARTPPYLQLQV-----LLRADDGAGEFSTSVTRPS--VLCDGQWHRLAVMKSGNVLRLEV    834
NOV1c                ARTPPYLQLQVLPRQVLLRADDGAGEFSTSVTRPS--VLCDGQWHRLAVMKSGNVLRLEV   3523
NOV1d                ARTPPYLQLQV-----LLRADDGAGEFSTSVTRPS--VLCDGQWHRLAVMKSGNVLRLEV   1566
gi|7459688|pir|      ALATPYMQLKVLTEQVLSANDGAGEFSTWVTYP---KLCDCSWHRMAVEMGRDTLRLEV   3535
gi|2497593|sp|Q      KNSYAILELVDN-TLYFTVKTDLKNIVSTNYKLPNNESFCDGKTRNVQAIKSKFVINIAV   3636
gi|14786772|ref      ARTPPYLQLQVTEKQVLLRADDGAGEFSTSVTRPS--VLCDGQWHRLAVMKSGNVLRLEV   1560
gi|2281044|emb|      ARTPPYLQLQVLPRQVLLRADDGAGEFSTSVTRPS--VLCDGQWHRLAVMKSGNVLRLEV    879
gi|17136292|ref      KNSYAILELVDN-TLYFTVKTDLKNIVSTNYKLPNNESFCDGKTRNVQAIKSKFVINIAV   3636
```

TABLE 1J-continued

ClustalW Analysis of NOV1

```
                         3790      3800      3810      3820      3830      3840
                    ....|....|....|....|....|....|....|....|....|....|....|....|
NOV1a               DAQS-NHTVGPLLAAAAGAPAPLYLGGLPEPMAVQ--PWPPAYCGCMRRLAVNRSPVAMT    3583
NOV1b               DAQS-NHTVGPLLAAAAGAPAPLYLGGLPEPMAVQ--PWPPAYCGCMRRLAVNRSPVAMT     891
NOV1c               DAQS-NHTVGPLLAAAAGAPAPLYLGGLPEPMAVQ--PWPPAYCGCMRRLAVNRSPVAMT    3580
NOV1d               DAQS-NHTVGPLLAAAAGAPAPLYLGGLPEPMAVQ--PWPPAYCGCMRRLAVNRSPVAMT    1623
gi|7459688|pir|     DTQS-NHTTGRLPESLAGSPALLLLGSLPKSSTAR--PELPAYRGCRRKLLNSAPVNYT    3592
gi|2497593|sp|Q     DFISSNPGVGNEGSVITRTNRPLSLGGHVAFQRAPGIKTKKSSKGCSSKVEVNSRMINIT    3696
gi|14786772|ref     DAQS-NHTVGPLLAAAAGAPAPLYLGGLPEPMAVQ--PWPPAYCGCMRRLAVNRSPVAMT    1617
gi|2281044|emb|     DAQS-NHTVGPLLAAAAGAPAPLYLGGLPEPMAVQ--PWPPAYCGCMRRLAVNRSPVAMT     936
gi|17136292|ref     DFISSNPGVGNEGSVITRTNRPLSLGGHVAFQRAPGIKTKKSSKGCSSKVEVNSRMINIT    3696

3850      3860      3870      3880
                    ....|....|....|....|....|....|....|....|...
NOV1a               RSVEVHGAVGASGCPAA--------------------------    3600
NOV1b               RSVEVHGAVGASGCPAA--------------------------     908
NOV1c               RSVEVHGAVGASGCPAA--------------------------    3597
NOV1d               RSVEVHGAVGASGCPAA--------------------------    1640
gi|7459688|pir|     ASVEEQGAVGMRGCPEGTLALSKQGKALTQRHAKPSVSPLLWH    3635
gi|2497593|sp|Q     PKMVVG-DEWQGYCPLN--------------------------    3712
gi|14786772|ref     RSVEVHGAVGASGCPAA--------------------------    1634
gi|2281044|emb|     RSVEVHGAVGASGCPAA--------------------------     953
gi|17136292|ref     PKMVVG-DEWQGYCPLN--------------------------    3712
```

The presence of identifiable domains in NOV1, as well as all other NOVX proteins, was determined by searches using software algorithms such as PROSITE, DOMAIN, Blocks, Pfam, ProDomain, and Prints, and then determining the Interpro number by crossing the domain match (or numbers) using the Interpro website the website of European Bioinformatics Institute, ebi.ac.uk/interpro). DOMAIN results for NOV1 as disclosed in Tables 1K–1L, were collected from the Conserved Domain Database (CDD) with Reverse Position Specific BLAST analyses. This BLAST analysis software samples domains found in the Smart and Pfam collections. For Table 1K and all successive DOMAIN sequence alignments, fully conserved single residues are indicated by black shading or by the sign (1) and "strong" semi-conserved residues are indicated by grey shading or by the sign (+). The "strong" group of conserved amino acid residues may be any one of the following groups of amino acids: STA, NEQK, NHQK, NDEQ, QHRK, MILV, MILF, HY, FYW.

Tables 1K–S list the domain descriptions from DOMAIN analysis results against NOV1a. This indicates that the NOV1a sequence has properties similar to those of other proteins known to contain this domain. Below are representative domain results. There are additional areas on NOV1a that also have homology to these Domains.

TABLE 1K

Domain Analysis of NOV1a

```
gnl|Smart|smart00136, LamNT, Laminin N-terminal domain (domain VI); N-
terminal domain of laminins and laminin-related protein such as Unc-6/
netrins. (SEQ ID NO:52)
CD-Length = 239 residues, 96.7% aligned
Score = 271 bits (692), Expect = 6e-73

Query:    26 PPYFNLAEGARIAASATCGEEAPARGSPRPTEDLYCKLVGGPVAGGDPNQTIQGQYCDIC    85
             | + ||| |  + ||+||||+ | |        ||||||        | ||+ || |
Sbjct:     9 PEFVNLAFGRPVTASSTCGEQGPER---------YCKLVGR---------TEQGKKCDYC    50

Query:    86 TAANSNKAHPASNAIDGTE----RWWQSPPLSRGLEYNEVNVTLDLGQVFHVAYVLIKFA   141
             | +  ++||| |  ||         |||| ||| | +   ||+||||+ ||+ ||++||
Sbjct:    51 DARDPRRSHPAENLTDGNNPGNPTWWQSEPLSNGPQ--NVNLTLDLGKEFHLTYVILKFC   108

Query:   142 NSPRPDLWVLERSMDFGRTYQPWQFFAASKRDCLERFGPQTLERITR--DDAAICTTEYS   199
             |||| | +|||| |||+|+|+|+|++    ||   ||+    +|+|||
Sbjct:   109 -SPRPSLAILERS-DFGKTWQPYQYFSS---DCRRTFGRPPRGPITKGNEQEVLCTSEYS   163

Query:   200 RIVPLENGEIVVSLVNGRPGAMNFSYSPLLREFTKATNVRLRFLRTNTLLGHLMGKALRD   259
             |||||  ||  | +|||  |+|   ||+|+|+  |||+|+|   |||    || | ||
Sbjct:   164 DIVPLEGGEIAFSTLEGRPSATDFDNSPVLQEWVTATNIRVRLTRLNTLGDDLMDK--RD   221

Query:   260 PTVTRRYYYSIKDISIGG   277
             | ||| |||+| ||++||
Sbjct:   222 PEVTRSYYYAISDIAVGG   239
```

TABLE 1L

Domain Analysis of NOV1a gnl|Pfam|pfam00055, laminin_Nterm, Laminin N-terminal (Domain VI).
(SEQ ID NO:53)
CD-Length = 237 residues, 100.0% aligned
Score = 219 bits (559), Expect = 2e-57

```
Query:   24 LHPPYFNLAEGARIAASATCGEEAPARGSPRPTEDLYCKLVGGPVAGGDPNQTIQGQYCD   83
               +|   ||| |  ++|++|||  +|         + ||   +    |          |
Sbjct:    1 CYPATGNLAIGRALSATSTCGLHSP---------EPYCILSH--LQPRDKK-------CF   42

Query:   84 ICTAANSNKA--HPASNAIDGTER----WWQSPPLSRGLEYNEVNVTLDLGQVFHVAYVL  137
            +| + +  |    ||| |     |        ||||  +  |++|   |+|||   || ||+
Sbjct:   43 LCDSNSPNPRNSHPISFLTDTFNPQSPTWWQSETMQNGVQYPNVTITLDLEAEFHFTYVI  102

Query:  138 IKFANSPRPDLWVLERSMDFGRTYQPWQFFAASKRDCLERFG--PQTLERITRDDA-AIC  194
            |  | +  ||   +  |||  |||   |+  |+|++|     ||    +  |+    | +|
Sbjct:  103 ITFK-TFRPAAMIYERSSDFG-TWIPYQYYAY---DCEATYPGIPRRPIRTGRAEDDVLC  157

Query:  195 TTEYSRIVPLENGEIVVSLVNGRPGAMNFSYSPLLREFTKATNVRLRFLRTNTLLGHLMG  254
            |+ ||  |   ||++   + |   |||      || +|+  ||||+|     +||  +|+
Sbjct:  158 TSRYSDIEPLTEGEVIFSTLEGRPSADNFDPSPRLQEWLKATNIRITLTRLHTLGDNLLD  217

Query:  255 KALRDPTVTRRYYYSIKDISIGG  277
               ||  |  +|||+|  ||  +||
Sbjct:  218 ---SDPEVLEKYYYAISDIVVGG  237
```

TABLE 1M

Domain Analysis of NOV1a gnl|Smart|smart00281, LamB, Laminin B domain (SEQ ID NO:54)
CD-Length = 127 residues, 98.4% aligned
Score = 152 bits (385), Expect = 2e-37

```
Query: 1674 PELYWQAPPSYLGDRVSSYGGTLRYELHSETQRGDVFVPMESRPDVVLQGNQMSITFLEP 1733
            +||  ||  +|||+|+||||  |||   + + |   +   | |||+|+|| + ++
Sbjct:    3 EPVYWVAPEQFLGDKVTSYGGKLRYTLSFDGREGGTTL---SAPDVILEGNGLRLSHPAQ   59

Query: 1734 AYPTPGHVHRGQLQLVEGNFRHTETRNTVSREELMMVLASLEQLQIRALFSQISSAVFLR 1793
            ||         +++  |  |+++     |+|+|+||||||+  + |||+|+  | |
Sbjct:   60 GPPLPDEETTNEVRFREENWQYFGGR-PVTREDLMMVLANLTAILIRATYSEQQLASRLS  118

Query: 1794 RVALEVASP 1802
            |+|||| |
Sbjct:  119 DVSLEVAVP  127
```

TABLE 1N

Domain Analysis of NOV1a gnl|Pfam|pfam00052, laminin_B, Laminin B (Domain IV). (SEQ ID NO:55)
CD-Length = 135 residues, 100.0% aligned
Score = 92.4 bits (228), Expect = 4e-19

```
Query: 1677 YWQAPPSYLGDRVSSYGGTLRYELHSETQRGDVFVPMESRPDVVLQGNQMSITFLEPAYP 1736
            ||+ |  +|||+|+||||  |+| +          |   |+|+|  +   ++ |
Sbjct:    1 YWRLPERFLGDQVTSYGGKLKYSV-----AFDGVGTSNSEPDVILKGNGLRLSVPYMAQG   55

Query: 1737 TP---GHVHRGQLQLVEGNFRHTETRNTVSREELMMVLASLEQLQIRALFSQISSAVFLR 1793
             +  ++|  |  |   +++  |+||+ +  |||+ +   +  +  ||  +|+  |
Sbjct:   56 NSYPSEVRVKYTVRLHE-TFWDFQSQPAVTREDFLSVLANLTAILIRATYSAGQAQSRLD  114

Query: 1794 RVALEVASPAGQGA-LASNVE 1813
            |+||+| |   |  |+ ||
Sbjct:  115 DVSLEIARPGAAGPVPATWVE  135
```

TABLE 1O

Domain Analysis of NOV1a gnl|Smart|smart00282, LamG, Laminin G domain (SEQ ID NO:56)
CD-Length = 135 residues, 88.1% aligned
Score = 76.6 bits (187), Expect = 2e-14

TABLE 10-continued

Domain Analysis of NOV1a

```
Query:  2759  FVMYMGSRQATGDYMGVSLRDKKVHWVYQLGEAGPAVLSIDEDI--GEQFAAVSLDRTLQ  2816
              ++|  ||+   ||++  +  |||  ++     |  ||  +|||  |+  |      |+   ||++|   +
Sbjct:    17  LLLYAGSKG-GGDFLALELRDGRLVLRYDLG-SGPARLTSDPTPLNDGQWHRVSVERNGR    74

Query:  2817  FGHMSVTVERQMIQETKGDTVAPGAEGLLNLRPDDFVFYVGGYPSTFTPPPLLRFPGYRG  2876
              +||     ++   |+      ||    +|+|    |     |+||  |      ||     ||+||
Sbjct:    75  RVTLSVDGGNRVSGES------PGGSTILDL---DGPLYLGGLPEDLKLPGLPVTPGFRG   125

Query:  2877  CIEMDTLNEE  2886
              ||    +|  +
Sbjct:   126  CIRNLKVNGK   135
```

TABLE 1P

Domain Analysis of NOV1a gnl|Pfam|pfam00053, laminin_EGF, Laminin EGF-like (Domains III and V).
This family is like pfam00008 but has 8 conserved cysteines instead of
6. (SEQ ID NO:57)
CD-Length = 49 residues, 100.0% aligned
Score = 59.3 bits (142), Expect = 4e-09

```
Query:  1561  CDCHEAGTAPGVCDPLTGQCYCKENVQGPKCDQCSLGTFSLDAANPKGC  1609
              |||+   |+     |||  ||||  ||    |   |  +||+|    |   +    |    +||
Sbjct:     1  CDCNPHGSLSDTCDPETGQCLCKPGVTGRRCDRCKPGYYGLPSDPGQGC    49
```

TABLE 1Q

Domain Analysis of NOV1a gnl|Smart|smart00180, EGF_Lam, Laminin-type epidermal growth factor-
like domai (SEQ ID NO:58)
CD-Length = 47 residues, 87.2% aligned
Score = 55.8 bits (133), Expect = 4e-08

```
Query:  1979  CDCTPCGT-EACDPHSGHCLCKAGVTGRRCDRCQEGHFGFD  2018
              |||  |   |+   |||  +|  |  ||   |||||||||   |++|
Sbjct:     1  CDCDPGGSASTCDPETGQCECKPNTTGRRCDRCAPGYYGLP    41
```

TABLE 1R

Domain Analysis of NOV1a gnl|Pfam|pfam01576, Myosin_tail, Myosin tail. The myosin molecule is a
multi-subunit complex made up of two heavy chains and four light
chains it is a fundamental contractile protein found in all eukaryote
cell types. This family consists of the coiled-coil myosin heavy chain
tail region. The coiled-coil is composed of the tail from two
molecules of myosin. These can then assemble into the macromolecular
thick filament. The coiled-coil region provides the structural
backbone the thick filament. (SEQ ID NO:59)
CD-Length = 860 residues, 60.6% aligned
Score = 53.1 bits (126), Expect = 3e-07

```
Query:  2205  RHETAQQLEVLEQQSTSLPPQAVGTRDQASQLLAGTEATLGHAKTLLA-AIRAVDRTLSE  2263
              |  +  +++|||   |+         +|    |    +|   ||      |||    +    |+
Sbjct:    69  RADLSRELEELSERLE----EAGGATAAQIELNKKREAELAKLRKDLEEANLQHEEALAT   124

Query:  2264  LMSQTGHLGLANASAPSGEQL-----LRTLAEVERLLWEMRARDLGAPQAAAEAELAAAQ  2318
              |   +   |    +|     ||+     +   ||  |+   +   |||   +       |+
Sbjct:   125  LRKK--H---QDAINELSEQIEQLQKQKAKAEKEKSQLQAEVDDLLAQLDSITKAKLNAE   179

Query:  2319  RVLARVQEQLSSLW----EENQALA--TQTRDRLAQHEAGLM-DLREALNRAVDATREAQ  2371
              +   +++ |||                |   + |    +  ||    +    |||   +  + ++
Sbjct:   180  KKAKQLESQLSELQVKLDELQRQLNDLTSQKSRLQSENSDLTRQLEEAEAQVSNLSKLKS   239

Query:  2372  ELNSRNQERLEEALQRKQELSRDNATLQATLHAARDTLASVFRLLEGLSPLK---FQELE  2428
              +|  |+   ||||   +  +||+  ||||  |         |+   ||   |     ++|
Sbjct:   240  QLESQ----LEEAKRSLEEESRERANLQAQLRQLEHDLSLREQLEEESEAKAELERQLS   295
```

TABLE 1R-continued

Domain Analysis of NOV1a

```
Query:  2429  RLAASLDGARTPL----LQRMQTFSPAGSKL--------RLVEAAEAHAQQLGQLALNLS  2476
              +  | +  |+        | +         ||         ||| |     | +    |
Sbjct:   296  KANAEIQQWRSKFESEGALRAEELEELKKKLNQKISELEEAAEAANAKCDSLEKTKSRLQ   355

Query:  2477  IILDVNQDRLTQRAIEASNAYSRILQAVQAAEDAAGQALQQADHTWQTVVR--QGLVDRA  2534
              |+            |  +| +|| +  |+  |     |          |+ |    | +| |
Sbjct:   356  SELEDL-----QIELERANAAASELEKKQKNFDKILAE-------WKRKVDELQAELDTA   403

Query:  2535  QQ--------LLANSTALEEANLQ------EQQRLGLGECWAPMGALRPAGTQLRDVRAK  2580
              |+           |      ||| |       | + |   |        |    | + ++
Sbjct:   404  QREARNLSTELFRLKNELEELKDQVEALRRENKNLQD-EIHDLTDQLGEGGRNVHELEKA   462

Query:  2581  KDQLEAHIQAAQAMLAMDTGETSKKIAHAKAVAAEAQDTATRVQSQLQAMQENVER----  2636
              + +|||        ||   |++  | +           +    | | +|  ++    +||
Sbjct:   463  RRRLEAEKDELQA--ALEEAEAA---------LELEESKVLRAQVELSQIRSEIERRLAE   511

Query:  2637  WQGQYEGLRGQ-----DLGQAVLDA----GSAVSTLEKTLPQLLAKLSI-LE--NRGVHN  2684
              + ++|    |       +   || |+|    +   | |+|      + +|   |+  |+
Sbjct:   512  KEEEFENTRKNHQRAIESLQATLEAETKGKAEASRLKKKLEGDINELEIALDHANKANAE   571

Query:  2685  ASLALSASIGRVRELIAQ  2702
              |    +      +|+|| |
Sbjct:   572  AQKNVKKYQQQVKELQTQ   589
```

TABLE 1S

Domain Analysis of NOV1a gnl|Pfam|pfam00054, laminin_G, Laminin G domain. (SEQ ID NO:60)
CD-Length = 134 residues, 89.6% aligned
Score = 47.8 bits (112), Expect = 1e-05

```
Query: 2760   VMYMGSRQATGDYMGVSLRDKKVHWVYQLGEAGPAVLSIDEDIGE-QFAAVSLDRTLQFG  2818
              ++| |+       |++ + ||| ++       | || +||||+    + + + ++   | |+|   + |
Sbjct:   10   LLYGGT-NTDRDFLALELRDGRLEVSYDLG-SGPAVVRSGDRLNDGKWHRVELERNGRKG    67

Query: 2819   HMSVTVERQMIQETKGDTVAPGAEGLLNLRPDDFVFYVGGYPSTFTPPPLLRF-PGYRGC  2877
              +||  |   +   |+       |  |+|   |       ||||  |       |        ++||
Sbjct:   68   TLSVDGEESVDGESPSGPDVPHE--NLDL---DTPLYVGGLPELSVKRLLAAISTSFKGC   122

Query: 2878   IEMDTLN  2884
              |    +|
Sbjct:  123   IRDVIVN   129
```

Laminins are the major noncollagenous components of basement membranes that mediate cell adhesion, growth, migration, and differentiation. They are composed of distinct but related alpha, beta and gamma chains. The three chains form a cross-shaped molecule that consist of a long arm and three short globular arms. The long arm consist of a coiled coil structure contributed by all three chains and cross-linked by interchain disulfide bonds. Beside different types of globular domains each subunit contains, in its first half, consecutive repeats of about 60 amino acids in length that include eight conserved cysteines. The tertiary structure of this domain is remotely similar in its N-terminal to that of the EGF-like module. It is known as a 'LE' or 'laminin-type EGF-like' domain. The number of copies of the LE domain in the different forms of laminins is highly variable; from 3 up to 22 copies have been found (1).

Miner et al (1) identified a fifth member of the alpha subfamily of vertebrate laminin chains. Consistent with the trimeric structure of laminin, all basal laminae characterized to that time contained at least 1 beta and at least 1 gamma chain. For the alpha chains, on the other hand, the situation was less clear. Using PCR, Miner et al. identified a novel murine alpha chain called alpha-5. Sequence analysis revealed a close relationship to the only known Drosophila alpha chain, suggesting that the ancestral alpha laminin gene is more similar to laminin alpha-5 than it is to laminin alpha-1, alpha-2, alpha-3, or alpha4. Analysis of RNA expression showed that alpha-5 is widely expressed in adult tissues, with highest levels in lung, heart, and kidney. It is speculated that the Laminin alpha 5 may be a major laminin chain of adult basal laminae. Dirkin et al (2) mapped the LAMA5 gene to 20q13.2-q13.3; the mouse gene (Lama5) was mapped by linkage analysis to a syntemic region of distal chromosome 2.

The novel sequence described here is a human homolog of mouse laminin alpha 5.

Because of its expression pattern (3–4), it is suggested that laminin laminin alpha5 plays role in the development of the human lung and skin morphogenesis. In addition, there is distinct temporal and spatial expression of these chains during proliferative and differentiation stages, possibly reflecting different functions (4).

The disclosed NOV1 nucleic acid of the invention encoding a Human laminin alpha 5-like protein includes the nucleic acid whose sequence is provided in Table 1A, 1C, 1E, 1G, or a fragment thereof. The invention also includes a mutant or variant nucleic acid any of whose bases may be changed from the corresponding base shown in Table 1A, 1C, 1E, or 1G while still encoding a protein that maintains its Human laminin alpha 5-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 31% percent of the bases may be so changed.

The disclosed NOV1 protein of the invention includes the Human laminin alpha 5-like protein whose sequence is provided in Table 1B, 1D, 1F, or 1H. The invention also includes a mutant or variant protein any of whose residues may be changed from the corresponding residue shown in Table 1B, 1D, 1F, or 1H while still encoding a protein that maintains its Human laminin alpha 5-like activities and physiological functions, or a functional fragment thereof. In the mutant or variant protein, up to about 54% percent of the residues may be so changed.

The invention further encompasses antibodies and antibody fragments, such as $F_{ab}$ or $(F_{ab})_2$, that bind immuno-specifically to any of the proteins of the invention.

The above defined information for this invention suggests that this Human laminin alpha 5-like protein (NOV1) may function as a member of a "Human laminin alpha 5 family". Therefore, the NOV1 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV1 nucleic acids and proteins of the invention are useful in potential therapeutic applications implicated in cancer including but not limited to various pathologies and disorders as indicated below. For example, a cDNA encoding the Human laminin alpha 5-like protein (NOV1) may be useful in gene therapy, and the Human laminin alpha 5-like protein (NOV1) may be useful when administered to a subject in need thereof. By way of nonlimiting example, the compositions of the present invention will have efficacy for treatment of patients suffering from Von Hippel-Lindau (KOHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration; Cholesteryl ester storage disease; Corneal dystrophy, Thiel-Behnke type; Dubin-Johnson syndrome; Leukemia, T-cell acute lymphocytic; Retinol binding protein, deficiency of; SEMD, Pakistani type; Spinocerebellar ataxia, infantile-onset, with sensory neuropathy; Split hand/foot malformation, type 3; Tolbutamide poor metabolizer; Urofacial syndrome; Warfarin sensitivity; Wolman disease, neuroprotection, fertility, diabetes, autoimmune disease, renal artery stenosis, interstitial nephritis, glomerulonephritis, polycystic kidney disease, systemic lupus crythematosus, renal tubular acidosis, IgA nephropathy, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, ulcers, systemic lupus erythematosus, autoimmune disease, asthma, emphysema, scleroderma, allergy, ARDS, or other pathologies or conditions. The NOV1 nucleic acid encoding the Human laminin alpha 5-like protein of the invention, or fragments thereof, may further be useful in diagnostic applications, wherein the presence or amount of the nucleic acid or the protein are to be assessed.

NOV1 nucleic acids and polypeptides are further useful in the generation of antibodies that bind immuno-specifically to the novel NOV1 substances for use in therapeutic or diagnostic methods. These antibodies may be generated according to methods known in the art, using prediction from hydrophobicity charts, as described in the "Anti-NOVX Antibodies" section below. The disclosed NOV1 proteins have multiple hydrophilic regions, each of which can be used as an immunogen. These novel proteins can be used in assay systems for functional analysis of various human disorders, which will help in understanding of pathology of the disease and development of new drug targets for various disorders.

NOV2

NOV2 includes three novel Human Hurpin/PI 13-like proteins disclosed below. The disclosed sequences have been named NOV2a, NOV2b, and NOV2c.

NOV2a

A disclosed NOV2a nucleic acid of 3105 nucleotides (also referred to as CG55999-01) encoding a novel Human Hurpin/PI 13-like protein is shown in Table 2A. An open reading frame was identified beginning with an ATG initiation codon at nucleotides 3840 and ending with a TAA codon at nucleotides 1238–1240. A The start and stop codons are in bold letters in Table 2A.

TABLE 2A

NOV2a nucleotide sequence (SEQ ID NO:9).

TGTTGTTCTTGCTATTCTAGGTCTCGCTAAAATCATCATGGATTCACTTGGCGCCGTCAGCACTCGACTTGG

GTTTGATCTTTTCAAAGAGCTGAAGAAAACAAATGATGCCAACATCTTCTTTTCCCCTGTGGGCATCTTAAC

TGCAATTGGCATGGTCCTCCTGGGGACCCGAGGAGCCACCGCTTCCCAGTTGGAGGAGGTGTTTCACTCTGA

TABLE 2A-continued

NOV2a nucleotide sequence (SEQ ID NO:9).

AAAAGAGACGAAGAGCTCAAGAATAAAGCCTGAAGAAAAAGAGGTGGTAAGAATAAAGGCTGAAGGAAAAGA

GATTGAGAACACAGAAGCAGTACATCAACAATTCCAAAAGTTTTTGACTGAAATAAGCAAACTCACTAATGA

TTATGAACTGAACATAACCAACAGGCTGTTTGGAGAAAAAACATACCTCTTCCTTCAAAAATACTTAGATTA

TGTTGAAAAATATTATCATGCATCTCTGGAACCTGTTGATTTTGTAAATGCAGCCCATCAAAGTCGAAAGAA

GATTAATTCCTGGGTTGAAAGCAAAACAAATGAAAAAATCAAGGACTTGTTCCCAGATGGCTCTATTAGTAG

CTCTACCAAGCTGGTGCTGGTGAACATGGTTTATTTTAAAGGGCAATGGGACAGGGAGTTTAAGAAAGAAAA

TACTAAGGAAGAGAAATTTTGGATGAATAAGAGCACAAGTAAATCTGTACAGATGATGACACAGAGCCATTC

CTTTAGCTTCACTTTCCTGGAGGACTTGCAGGCCAAAATTCTAGGGATTCCATATAAAAACAACGACCTAAG

CATGTTTCTCCTTCTGCCCAACGACATCGATGGCCTCGAGAAGATAATAGATAAAATAAGTCCTGAGAAATT

GGTAGAGTGGACTAGTCCAGGGCATATGGAAGAAAGAAAGGTGAATCTGCACTTGCCCCGGTTTGAGGTGGA

GGACGGTTACGATCTAGAGGCGGTCCTGGCTGCCATGGGATGGGCGATGCCTTCAGTGAGCACAAAGCCGA

CTACTCGGGAATGTCGTCACGCTCCGGGTTGTACGCCCAGAAGTTCCTGCACAGTTCCTTTGTGGCAGTAAC

TGAGGAAGGCACCGACGCTGCACCTGCCACCGGCATAGGCTTTACTGTCACATCCGCCCCAGGTCATGAAAA

TGTTCACTGCAATCATCCCTTCCTGTTCTTCATCAGGCACAATGAATCCAACAGCATCCTCTTCTTCGGCAG

ATTTTCTTCTCCTTAAGATGATCGTTGCCATGGCATTGCTGCTTTTAGCAAAAAACAACTACCAGTGTTACT

CATATGATTATGAAAATCGTCCATTCTTTTAAATGTTGTCTCACTTGCATTTCCAGTCTTGGCCATCAAATC

AATGATTTAATGACTCCAATAATCTGTGTGTTTATAACCATCCTCGAAAGTGAAATGTCCTTTTTTTTGTGC

CATCCGTAAGGTGAGTCAAACCAAACCTCATTGATAATCTCCCCTTTGGTTTCCTTTGAAAGTAAATTGGTA

TCTTGTAGTTTTGTGCACACGAAAGGAGAGAAAGTTTCTCCAGTAAAGAGTACGAACTAGTAATTTTGGGGG

GTCTCTCTAATTCTGGTATTTTGACATGTTATAATACGCAAGTAAAATAAAACAATACTTTACTCAGCTCAT

GTTACTATTCCCCAACAGATATTGTGGCAAATCACACATAGGAAAGAGGATTTGGGAATACAGTAGCAAAAC

ATAAATTAAAACTCAAATGCCCAGGACAAAATAAAACAATATACCAGATGGAGAGGATGCCCGTATTTTCAT

CTTCCATTCTAACATTATCCATTGTTAGATGCATAAGCATTTTGATATTGTGTAATAAATGTGGTATTTGAG

AAGATAAATGATGTAGTTGATCAGTAATCCTCCTCTATCACCTTTTTAGACTTTGTAAGGTAAATATTTGGA

CTAACTTTTAGAAAAGTTTCCCTTTTTTTCTCCATTTACATTTTTCTGGTTTTTTTTTTTTTTGAGTGA

GGTACGAGTATTACCAAATGATATTTTCTGAACATGCTTTTTGGAAAGCTCTGAATCTATACCTAATGCTCT

TAATTATTGGCTTGTTTCATTTTTTTCCTCCAGTTTTTAACAAGATCACATAACTGGCTTATTTTTAACAGC

TTTGTCAAACTACAATTTACATGCCGTAAAATGTACACACTGTAATTTTATAATTCATTGACTTTTAGTAAA

TTTTCTAGCGTTATGCATCGCCACAATCCAGTTTTAGAATATTTCCATGACCCTAAGAACTTTCCTCATGTC

TATTAATATTCCCAATCCTACGCACCACTGAGTTGTTTTCTGTCTTTATAAGTTTTTCTTTCTACATCTTAT

ATAAATGGAATCATAATACATGTAGTATTTTGTGTCTGGCGTCTTGCACTTAGCATGGCGTTCTTGAGGTTC

ATCTGTTGTAGTATGTATTGATACTTAGGATTTTTTTATTGCCGAATACTATTCCATTGCATGGAAAAGACC

TATTTTATTTCTACGTTCACCAGTTGAGGGACATTTGGATTGTTCCCACTTCTTGGGCTGTTAGGAATAATG

TTGCTCTGAACATGTAAATAAAGATCTTTGTGTTCACATATGTTTTTCATTTTCTGTTGGGGAGATTCCCTA

GGCTAGAAATTGCTGGGCCATATGAAAAATCAATAGTTAGCTTTGTAAGAAACAGTCAAACTGTTTTCCCAA

CGTGACATTTTATATTCCCACCACOAATGTTTAAAACTAGTGTCTTCAAATCCTCACCAACATCCAGGATTG

TGTCTTTATGATTATAGCCATTTTTGTAGGTACAAAGTGGCATCTCATGGTGGTTTTAATTTGCATTTCCAT

AATATCTAATTAGGTTGAGCTTTTTTTATGTGCTTATTGGCCATTTGTTTGACTTTGTTTGCTGAAATGTAT

ACAAATCATTTGCTCATTTTTAATTTGGGTTGTCTGTCTTGTCTTCTCATTTTATTGAGTTAAATGAGTTCT

TABLE 2A-continued

NOV2a nucleotide sequence (SEQ ID NO:9).

TAATAATCTCTGGCTTACAAGTCCTTAATTTATCAAATATATGATACGTGGACATTTCCTCATAAAAAAAAA

AAAAAAAAA

The disclosed NOV2a nucleic acid sequence, localized to the q21.3-22 region of chromsome 18, has 2854 of 2866 bases (99%) identical to a gb:GENBANK-ID:HSPI13711|acc:AJ001696.2 mRNA from *Homo sapiens* (*Homo sapiens* mRNA for hurpin, clone R7-1.1) (E=0.0).

A NOV2a polypeptide (SEQ ID NO:10) encoded by SEQ ID NO:9 has 400 amino acid residues and is presented using the one-letter code in Table 2B. Signal P, Psort and/or Hydropathy results predict that NOV2a contains a signal peptide and is likely to be localized to the plasma membrane with a certainty of 0.7900. In other embodiments, NOV2a may also be localized to the microbody (peroxisome) with a certainty of 0.7106, the Golgi body with a certainty of 0.3000, or the endoplasmic reticulum (membrane) with a certainty of 0.2000. The most likely cleavage site for NOV2a is between positions 50 and 51: ATA-SQ.

ID:HSPI13711|acc:AJ001696.2) a closely related *Homo sapiens* mRNA for hurpin, clone R7-1.1 homolog.

NOV2b

In the present invention, the target sequence identified previously, NOV2a, was subjected to the exon linking process to confirm the sequence. PCR primers were designed by starting at the most upstream sequence available, for the forward primer, and at the most downstream sequence available for the reverse primer. In each case, the sequence was examined, walking inward from the respective termini toward the coding sequence, until a suitable sequence that is either unique or highly selective was encountered, or, in the case of the reverse primer, until the stop codon was reached. Such primers were designed based on in silico predictions for the full length cDNA, part (one or more exons) of the DNA or protein sequence of the

TABLE 2B

Encoded NOV2a protein sequence.

(SEQ ID NO:10)
MDSLGAVSTRLGFDLFKELKKTNDGNIFFSPVGILTAIGMVLLGTRGATASQLEEVFHSEKETKSSRIKAEE

KEVVRIKAEGKEIENTEAVHQQFQKFLTEISKLTNDYELNITNRLFGEKTYLFLQKYLDYVEKYYHASLEPV

DFVNAADESRKKINSWVESKTNEKIKDLFPDGSISSSTKLVLVNMVYFKGQWDREFKKENTKEEKFWMNKST

SKSVQMMTQSHSFSFTFLEDLQAKILGIPYKNNDLSMFVLLPNDIDGLEKIIDKISPEKLVEWTSPGHMEER

KVNLHLPRFEVEDGYDLEAVLAAMGMGDAFSEHKADYSGMSSGSGLYAQKFLHSSFVAVTEEGTEAAAATGI

GFTVTSAPGHENVHCNHPFLFFIRHNESNSILFFGRFSSP

The disclosed NOV2a amino acid sequence has 391 of 400 amino acid residues (97%) identical to, and 391 of 400 amino acid residues (97%) similar to, the 391 amino acid residue ptnr:SWISSNEW-ACC:Q9UIV8 protein from *Homo sapiens* (Human) (Hurpin (RACAT UV-Repressible Serpin) (Protease Inhibitor 13) (Headpin) (E=5.8e$^{-20}$).

NOV2a is expressed in at least the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. This information was derived by determining the tissue sources of the sequences that were included in the invention including but not limited to SeqCalling sources, Public EST sources, and/or RACE sources.

In addition, the sequence is predicted to be expressed in keratinocytes because of the expression pattern of (GENBANK-ID: gb:GENBANK-target sequence, or by translated homology of the predicted exons to closely related human sequences sequences from other species. These primers were then employed in PCR amplification based on the following pool of human cDNAs: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. Usually the resulting amplicons were gel purified, cloned and sequenced to high redundancy. The resulting sequences from all clones were assembled with themselves, with other fragments in CuraGen Corporation's database and with public ESTs. Fragments and ESTs were included as components for an assembly when the extent of their identity with another component of the assembly was at least 95% over 50 bp. In addition, sequence traces were evaluated manually and edited for corrections if appropriate. These procedures provide the sequence reported below, which is designated NOV2b. This differs from the previously identified sequence (NOV2a) in having 2 different aminoacids.

A disclosed NOV2b nucleic acid of 1238 nucleotides (also referred to as CG55999-02) encoding a novel Human Hurpin/PI 13-like protein is shown in Table 2C. An open reading frame was identified beginning with an ATG initiation codon at nucleotides 24–26 and ending with a TAA codon at nucleotides 1224–1226. A The start and stop codons are in bold letters in Table 2C and the 5' and 3' untranslated regions are underlined.

169949|acc:AF169949.1 mRNA from *Homo sapiens* (*Homo sapiens* headpin mRNA, complete cds) (E=1.4e$^{-215}$).

A NOV2b polypeptide (SEQ ID NO: 12) encoded by SEQ ID NO:11 has 400 amino acid residues and is presented using the one-letter code in Table 2D. Signal P, Psort and/or Hydropathy results predict that NOV2b contains a signal peptide and is likely to be localized to the plasma membrane with a certainty of 0.7900. In other embodiments, NOV2b may also be localized to the microbody (peroxisome) with a certainty of 0.7147, the Golgi body with a certainty of

TABLE 2C

NOV2b nucleotide sequence (SEQ ID NO:11).

TTCTAGGTCTCGCTAAAATCATCATGGATTCACTTGGCGCCGTCAGCACTCGACTTGGGTTTGATCTTTTCA

AAGAGCTGAAGAAAACAAATGATGGCAACATCTTCTTTTCCCCTGTGGGCATCTTGACTGCAATTGGCATGG

TCCTCCTGGGGACCCGAGGAGCCACCGCTTCCCAGTTGGAGGAGGTGTTTCACTCTGAAAAAGAGACGAAGA

GCTCAAGAATAAAGGCTGAAGAAAAAGAGGTGGTAAGAATAAAGGCTGAAGGAAAAGAGATTGAGAACACAG

AAGCAGTACATCAACAATTCCAAAAGTTTTTGACTGAAATAAGCAAACTCACTAATGATTATGAACTGAACA

TAACCAACAGGCTGTTTGGAGAAAAAACATACCTCTTCCTTCAAAAATACTTAGATTATGTTGAAAAATATT

ATCATGCATCTCTGGAACCTGTTGATTTTGTAAATGCAGCCGATGAAAGTCGAAAGAAGATTAATTCCTGGG

TTGAAAGCAAAACAAATGAAAAAATCAAGGACTTGTTCCCAGATGGCTCTATTAGTAGCTCTACCAAGCTGG

TGCTGGTGAACATGGTTTATTTTAAAGGGCAATGGGACAGGGGGTTTAAGAAAGAAAATACTAAGGAAGAGA

AATTTTGGATGAATAAGAGCACAAGTAAATCTGTACAGATGATGACACAGAGCCATTCCTTTAGCTTCACTT

TCCTGGAGGACTTGCAGGCCAAAATTCTAGGGATTCCATATAAAAACAACGACCTAAGCATGTTTGTGCTTC

TGCCCAACGACATCGATGGCCTGGAGAAGATAATAGATAAAATAAGTCCTGAGAAATTGGTAGAGTGGACTA

GTCCAGGGCATATGGAAGAAAGAAAGGTGAATCTGCACTTGCCCCGGTTTGAGGTGGAGGACAGTTACGATC

TAGAGGCGGTCCTGGCTGCCATGGGGATGGGCGATGCCTTCAGTGAGCACAAAGCCGACTACTCGGGAATGT

CGTCAGGCTCCGGGTTGTACGCCCAGAAGTTCCTGCACAGTTCCTTTGTGGCAGTAACTGAGGAAGGCACCG

AGGCTGCAGCTGCCACTGGCATAGGCTTTACTGTCACATCCGCCCCAGGTCATGAAAATGTTCACTGCAATC

ATCCCTTCCTGTTCTTCATCAGGCACAATGAATCCAACAGCATCCTCTTCTTCGGCAGATTTTCTTCTCCTT

AAGATGATCGTTGC

The disclosed NOV2b nucleic acid sequence, localized to the q21.3 region of chromsome 18, has 999 of 1013 bases (98%) identical to a gb:GENBANK-ID:AF 0.3000, or the endoplasmic reticulum (membrane) with a certainty of 0.2000. The most likely cleavage site for NOV2b is between positions 50 and 51: ATA-SQ.

TABLE 2D

Encoded NOV2b protein sequence (SEQ ID NO:12).

MDSLGAVSTRLGFDLFKELKKTNDGNIFFSPVGILTAIGMVLLGTRGATASQLEEVFHSEKETKSSRIKAEE

KEVVRIKAEGKEIENTEAVHQQFQKFLTEISKLTNDYELNITNRLFGEKTYLFLQKYLDYVEKYYHASLEPV

DFVNAADESRKKINSWVESKTNEKIKDLFPDGSISSSTKLVLVNMVYFKGQWDRGFKKENTKEEKFWMNKST

SKSVQMMTQSHSFSFTFLEDLQAKILGIPYKNNDLSMFVLLPNDIDGLEKIIDKISPEKLVEWTSPGHMEER

KVNLHLPRFEVEDSYDLEAVLAAMGMGDAFSEHKADYSGMSSGSGLYAQKFLHSSFVAVTEEGTEAAAATGI

GFTVTSAPGHENVHCNHPFLFFIRHNESNSILFFGRFSSP

The disclosed NOV2b amino acid sequence has 390 of 400 amino acid residues (97%) identical to, and 390 of 400 amino acid residues (97%) similar to, the 391 amino acid residue ptnr:SPTREMBL-ACC:Q9UKG0 protein from *Homo sapiens* (Human) (READPIN) (E=5.3e$^{-205}$).

NOV2b is expressed in at least the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea and uterus, Buccal mucosa, Cervix, Coronary Artery, Skin, Vulva.

Expression information was derived from the tissue sources of the sequences that were included in the derivation of the sequence of CuraGen Acc. No. CG55999-02.

The sequence is predicted to be expressed in keratinocytes because of the expression pattern of (GENBANK-ID: gb:GENBANK-ID:AF169949|acc:AF169949.1) a closely related *Homo sapiens* headpin mRNA, complete cds homolog in species *Homo sapiens*.

NOV2c

A disclosed NOV2c nucleic acid of 1559 nucleotides (also referred to as CG55999-05) encoding a novel Human Hurpin/PI 13-like protein is shown in Table 2E. An open reading frame was identified beginning with an ATG initiation codon at nucleotides 353–355 and ending with a TAA codon at nucleotides 1553–1555. A The start and stop codons are in bold letters in Table 2E and the 5' and 3' untranslated regions are underlined.

TABLE 2E

NOV2c nucleotide sequence (SEQ ID NO:13).

AAGCTTCCATGAAGAGGAGGCTGTGGAGAGGCAGAGACAGGCAGGGTCAGACAGAGAGCAAGAGAATAAAGC

CATTAAAACATTAACCCTGCTCCGCGGGAAATAAGAACTGAGCACCACCGGATGACGGAAGACTCCAGTAG

ATTGATGGATGTCTCCCAGCAAGAGAAGGCCAAGAGAGGACGTGAGAAGCAGGCAGCAGCGACCTTTCACCA

AAAGGGTGGAAATCCCTGTATTCCGGATCGATGCAAGAAGAGGAATAGAAGCAGAAAGGATTCCCCTGACAC

AGAGTAATTCAAATGTTCAGTTTTGATTGTTGTTCTTGCTATTCTAGGTCTCGCTAAAATCATCATGGATTC

ACTTGGCGCCGTCAGCACTCGACTTGGGTTTGATCTTTTCAAAGAGCTGAAGAAAACAAATGATGGCAACAT

CTTCTTTTCCCCTGTGGGCATCTTGACTGCAATTGGCATGGTCCTCCTGGGGACCCGAGGAGCCACCGCTTC

CCAGTTGGAGGAGGTGTTTCACTCTGAAAAAGAGACGAAGAGCTCAAGAATAAAGGCTGAAGAAAAAGAGGT

GGTAAGAATAAAGGCTGAAGGAAAAGAGATTGAGAACACAGAAGCAGTACATCAACAATTCCAAAAGTTTTT

GACTGAAATAAGCAAACTCACTAATGATTATGAACTGAACATAACCAACAGGCTGTTTGGAGAAAAAACATA

CCTCTTCCTTCAAAAATACTTAGATTATGTTGAAAAATATTATCATGCATCTCTGGAACCTGTTGATTTTGT

AAATGCAGCCGATGAAAGTCGAAAGAAGATTAATTCCTGGGTTGAAAGCAAAACAAATGAAAAAATCAAGGA

CTTGTTCCCAGATGGCTCTATTAGTAGCTCTACCAAGCTGGTGCTGGTGAACATGGTTTATTTTAAAGGGCA

ATGGGACACGGAGTTTAAGAAAGAAAATACTAAGGAAGAGAAATTTTGGATGAATAAGAGCACAAGTAAATC

TGTACAGATGATGACACAGAGCCATTCCTTTAGCTTCACTTTCCTGGAGGACTTGCAGGCCAAAATTCTAGG

GATTCCATATAAAAACAACGACCTAAGCATGTTTGTGCTTCTGCCCAACGACATCGATGGCCTGGAGAAGAT

AATAGATAAAATAAGTCCTGAGAAATTGGTAGAGTGGACTAGTCCAGGGCATATGGAAGAAAGAAAGGTGAA

TCTGCACTTGCCCCGGTTTGAGGTGGAGGACAGTTACGATCTAGAGGCGGTCCTGGCTGCCATGGGGATGGG

CGATGCCTTCAGTGAGCACAAAGCCGACTACTCGGGAATGTCGTCAGGCTCCGGGTTGTACGCCCAGAAGTT

CCTGCACAGTTCCTTTGTGGCAGTAACTGAGGAAGGCACCGAGGCTGCAGCTGCCACTGGCATAGGCTTTAC

TGTCACATCCGCCCCAGGTCATGAAAATGTTCACTGCAATCATCCCTTCCTGTTCTTCATCAGGCACAATGA

ATCCAACAGCATCCTCTTCTTCGGCAGATTTTCTTCTCCTTAAGATG

The disclosed NOV2c nucleic acid sequence, localized to the q21.3-22 region of chromsome 18, has 519 of 519 bases (100%) identical to agb:GENBANK-ID:AF216854|acc:AF216854.1 mRNA from *Homo sapiens* (*Homo sapiens* headpin gene, complete cds) (E=2.3e$^{303}$).

A NOV2c polypeptide (SEQ ID NO:14) encoded by SEQ ID NO:13 has 400 amino acid residues and is presented using the one-letter code in Table 2F. Signal P, Psort and/or Hydropathy results predict that NOV2c contains a signal peptide and is likely to be localized 110 to the plasma membrane with a certainty of 0.7900. In other embodiments, NOV2c may also be localized to the microbody (peroxisome) with a certainty of 0.7024, the Golgi body with a certainty of 0.3000, or the endoplasmic reticulum (membrane) with a certainty of 0.2000. The most likely cleavage site for NOV2c is between positions 50 and 51: ATA-SQ.

The disclosed NOV2d nucleic acid sequence, localized to the q21.3-22 region of chromsome 18, has 214 of 214 bases (100%) identical to a gb:GENBANK-ID:AF216854|acc:AF216854.1 mRNA from *Homo sapiens* (*Homo sapiens* headpin gene, complete cds) (E=1.3e$^{-134}$).

A NOV2d polypeptide (SEQ ID NO:16) encoded by SEQ ID NO:15 has 175 amino acid residues and is presented using the one-letter code in Table 2H. Signal P, Psort and/or Hydropathy results predict that NOV2d contains a signal peptide and is likely to be localized to the plasma membrane with a certainty of 0.7900. In other embodiments, NOV2d may also be localized to the microbody (peroxisome) with a certainty of 0.3878, the Golgi body with a certainty of 0.3000, or the endoplasmic reticulum (membrane) with a certainty of 0.2000. The most likely cleavage site for NOV2d is between positions 50 and 51: ATA-SQ.

TABLE 2F

Encoded NOV2c protein sequence (SEQ ID NO:14).

MDSLGAVSTRLGFDLFKELKKTNDGNIFFSPVGILTAIGMVLLGTRGATASQLEEVFHSEKETKSSRIKAEE

KEVVRIKAEGKEIENTEAVHQQFQKFLTEISKLTNDYELNITNRLFGEKTYLFLQKYLDYVEKYYHASLEPV

DFVNAADESRKKINSWVESKTNEKIKDLFPDGSISSSTKLVLVNMVYFKGQWDREFKKENTKEEKFWMNKST

SKSVQMMTQSHSFSFTFLEDLQAKILGIPYKNNDLSMFVLLPNDIDGLEKIIDKISPEKLVEWTSPGHMEER

KVNLHLPRFEVEDSYDLEAVLAAMGMGDAFSEHKADYSGMSSGSGLYAQKFLHSSFVAVTEEGTEAAAATGI

GFTVTSAPGHENVHCNHPFLFFIRHNESNSILFFGRFSSP

The disclosed NOV2c amino acid sequence has 391 of 400 amino acid residues (97%) identical to, and 391 of 400 amino acid residues (97%) similar to, the 391 amino acid residue ptnr:SPTREMBL-ACC:Q9UKG0 protein from *Homo sapiens* (Human) (Headpin) (E=1.1e$^{-205}$)

NOV2d

A disclosed NOV2d nucleic acid of 818 nucleotides (also referred to as CG55999-06) encoding a novel Human Hurpin/PI 13-like protein is shown in Table 2G. An open reading frame was identified beginning with an ATG initiation codon at nucleotides 40–42 and ending with a TAA codon at nucleotides 565–567. A The start and stop codons are in bold letters in Table 2G and the 5' and 3' untranslated regions are underlined.

TABLE 2G

NOV2d nucleotide sequence (SEQ ID NO:15).

<u>ACCGTCTCTCCAAAAACCCGAGGTCTCGCTAAAATCATC</u>ATGGATTCACTTGGCGCCGTCAGCACTCGACTT

GGGTTTGATCTTTTCAAAGAGCTGAAGAAAACAAATGATGGCAACATCTTCTTTTCCCCTGTGGGCATCTTG

ACTGCAATTGGCATGGTCCTCCTGGGGACCCGAGGAGCCACCGCTTCCCAGTTGGAGGAGGTGTTTCACTCT

GAAAAAGAGACGAAGAGCTCAAGAATAAAGGCTGAAGAAAAAGAGGTGGTAAGAATAAAGGCTGAAGGAAAA

GAGATTGAGAACACAGAAGCAGTACATCAACAATTCCAAAAGTTTTTGACTGAAATAAGCAAACTCACTAAT

GATTATGAACTGAACATAACCAACAGGCTGTTTGGAGAAAAAACATACCTCTTCCTTCAAAAATACTTAGAT

TATGTTGAAAAATATTATCATGCATCTCTGGAACCTGTTGATTTTGTAAATGCAGCCGATGAAAGTCGAAAG

AAGATTAATTCCTGGGTTGAAAGCAAAACAAATGATGTGGAAACTGAGGCACAGAGAGTTTAA<u>ATAACTTGC

CCAAGATTCCTCAGCTGATAAGAGGCAAACTGGATGCTAACAGAGGCATCTGACCCCAGAGTCTGGACTCTT

AACCATGAACCTTAATTTATCCACTGGGATAAATAGGCGATGGGCAAAATGAGAACCTCCCCGTCGATTCTG

CCAGCAAACCCTTTGTCAGCAAGGCCCTCAGAAAAAATCAAGGACTTGTTCCCAGATGGCTCTATTAGTAGC

TCTACCAAGCTGGTGCTGGTGACATG</u>

TABLE 2H

Encoded NOV2d protein sequence (SEQ ID NO:16).

MDSLGAVSTRLGFDLFKELKKTNDGNIFFSPVGILTAIGMVLLGTRGATASQLEEVFHSEKETKSSRIKAEE

KEVVRIKAEGKEIENTEAVHQQFQKFLTEISKLTNDYELNITNRLFGEKTYLFLQRKYLDYVEKYYHASLEPV

DFVNAADESRKKINSWVESKTNDVETEAQRV

The disclosed NOV2d amino acid sequence has 157 of 167 amino acid residues (94%) identical to, and 158 of 167 amino acid residues (94%) similar to, the 391 amino acid residue ptnr:SWISSNEW-ACC:Q9UIV8 protein from *Homo sapiens* (Human) (HURPIN (HACAT UV-Repressible Serpin) (Protease Inhibitor 13) (Headpin)) (E=2.2e $^{-76}$).

NOV2d is expressed in at least the following tissues: Mammalian Tissue, Coronary Artery, Buccal mucosa, Pituitary Gland, Cervix, Uterus, Vulva, Skin. Expression information was derived from the tissue sources of the sequences that were included in the derivation of the sequence of CuraGen Acc. No. CG55999-06.

NOV2e

A disclosed NOV2e nucleic acid of 1062 nucleotides (also referred to as 166485357) encoding a novel Human Hurpin/PI 13-like protein is shown in Table 2I. An open reading frame was identified beginning with an GGA initiation codon at nucleotides 1–3 and ending with a GAG codon at nucleotides 1060–1062. A The start and stop codons are in bold letters in Table 2I. Since the start and stop codons are not traditional initiation and termination codons, NOV2e may be a partial reading frame that extends further in the 5' and 3' directions.

TABLE 2I

NOV2e micleotide sequence (SEQ ID NO:197).

GGATCCTCCCAGTTGGAGGAGGTGTTTCACTCTGAAAAAGAGACGAAGAGCTCAAGAATAAAGGCTGAAGAA

AAAGAGGTGGTAAGAATAAAGGCTGAAGGAAAAGAGATTGAGAACACAGAAGCAGTACATCAACAATTCCAA

AAGTTTTTGACTGAAATAAGCAAACTCACTAATGATTATGAACTGAACATAACCAACAGGCTGTTTGGAGAA

AAAACATACCTCTTCCTTCAAAAATACTTAGATTATGTTGAAAAATATTATCATGCATCTCTGGAACCTGTT

GATTTTGTAAATGCAGCCGATGAAAGTCGAAAGAAGATTAATTCCTGGGTTGAAAGCAAAACAAATGAAAAA

ATCAAGGACTTGTTCCCAGATGGCTCTATTAGTAGCTCTACCAAGCTGGTGCTGGTGAACATGGTTTATTTT

AAAGGGCAATGGGACAGGGAGTTTAAGAAAGAAAATACTAAGGAAGAGAAATTTTGGATGAATAAGAGCACA

AGTAAATCTGTACAGATGATGACACACAGCCATTCCTTTAGCTTCACTTTCCTGGAGGACTTGCAGGCCAAA

ATTCTAGGGATTCCATATAAAAACAACGACCTAAGCATGTTTGTGCTTCTGCCCAACGACATCGATGGCCTG

GAGAAGATAATAGATAAAATAAGTCCTGAGAAATTGGTAGAGTGGACTAGTCCAGGGCATATGGAAGAAAGA

AAGGTGAATCTGCACTTGCCCCGGTTTGAGGTGGAGGACAGTTACGATCTAGAGGCGGTCCTGGCTGCCATG

GGGATGGGCGATGCCTTCAGTGAGCACAAAGCCGACTACTCGGGAATGTCGTCAGGCTCCGGGTTGTACGCC

CAGAAGTTCCTGCACAGTTCCTTTGTGGCAGTAACTGAGGAAGGCACCGAGGCTGCAGCTGCCACTGGCATA

GGCTTTACTGTCACATCCGCCCCAGGTCATGAAAATGTTCACTGCAATCATCCCTTCCTGTTCTTCATCAGG

CACAATGAATCCAACAGCATCCTCTTCTTCGGCAGATTTTCTTCTCCTCTCGAG

A NOV2e polypeptide (SEQ ID NO:14) encoded by SEQ ID NO:13 has 354 amino acid residues and is presented using the one-letter code in Table 2J.

TABLE 2J

Encoded NOV2e protein sequence (SEQ ID NO:198).

GSSQLEEVFHSEKETKSSRIKAEEKEVVRIKAEGKEIENTEAVHQQFQKFLTEISKLTNDYELNITNRLFGE

KTYLFLQKYLDYVEKYYHASLEPVDFVNAADESRKKINSWVESKTNEKIKDLFPDGSISSSTKLVLVNMVYF

TABLE 2J-continued

Encoded NOV2e protein sequence (SEQ ID NO:198).

KGQWDREFKKENTKEEKFWMNKSTSKSVQMMTQSHSFSFTFLEDLQAKILGIPYKNNDLSMFVLLPNDIDGL

EKIIDKISPEKLVEWTSPGHMEERKVNLHLPRFEVEDSYDLEAVLAAMGMGDAFSEHKADYSGMSSGSGLYA

QKFLHSSFVAVTEEGTEAAAATGIGFTVTSAPGHENVHCNHPFLFFIRHNESNSILFFGRFSSPLE

NOV2a also has homology to the amino acid sequences shown in the BLASTP data listed in Table 2I.

TABLE 2K

BLAST results for NOV2

| Gene Index/ Identifier | Protein/ Organism | Length (aa) | Identity (%) | Positives (%) | Expect |
|---|---|---|---|---|---|
| gi\|8393956\|ref\|NP_036529.1\| (NM_012397) | serine (or cysteine) proteinase inhibitor, clade B | 391 | 364/400 (91%) | 364/400 (91%) | 0.0 |
| gi\|6018510\|emb\|CAA04937.1\| (AJ001698) | hurpin [Homo sapiens] | 390 | 362/400 (90%) | 363/400 (90%) | 0.0 |
| gi\|7522623\|pir\|\|JC7118 | headpin serine proteinase inhibitor - human | 391 | 363/400 (90%) | 363/400 (90%) | 0.0 |
| gi\|9801227\|emb\|CAC03569.1\| (AJ278717) | hurpin [Homo sapiens] | 339 | 311/400 (77%) | 312/400 (77%) | e-162 |
| gi\|266995\|sp\|P29508\| SCC1_HUMAN | SQUAMOUS CELL CARCINOMA ANTIGEN 1 (SCCA-1) (PROTEIN T4-A) | 390 | 209/401 (52%) | 274/401 (68%) | e-107 |

The homology of these sequences is shown graphically in the ClustalW analysis shown in Table 2L.

TABLE 2L

ClustalW Analysis of NOV2

1) NOV2a (SEQ ID NO:10)
2) NOV2b (SEQ ID NO:12)
3) NOV2c (SEQ ID NO:14)
4) NOV2d (SEQ ID NO:16)
5) NOV23 (SEQ ID NO:198)
6) gi|8393956|ref|NP_036529.1| (NM_012397) serine (or cysteine) proteinase inhibitor, clade B (SEQ ID NO:61)
7) gi|6018510|emb|CAA04937.1| (AJ001698) hurpin [Homo sapiens] (SEQ ID NO:62)
8) gi|7522623|pir||JC7118 headpin serine proteinase inhibitor - human (SEQ ID NO:63)
9) gi|9801227|emb|CAC03569.1| (AJ27817) hurpin [Homo sapiens] (SEQ ID NO:64)
10) gi|266995|sp|P29508|SCC1_HUMAN SQUAMOUS CELL CARCINOMA ANTIGEN 1 (SCCA-1) (PROTEIN T4-A) (SEQ ID NO:65)

```
                          10        20        30        40        50        60
                 ....|....|....|....|....|....|....|....|....|....|....|....|
NOV2a            MDSLGAVSTRLGFDLFKELKKTNDGNIFFSFVGILTAIGMVLLGTRGATASQLEEVFHSE    60
NOV2b            MDSLGAVSTRLGFDLFKELKKTNDGNIFFSFVGILTAIGMVLLGTRGATASQLEEVFHSE    60
NOV2c            MDSLGAVSTRLGFDLFKELKKTNDGNIFFSFVGILTAIGMVLLGTRGARASQLEEVFHSE    60
NOV2d            MDSLGAVSTRLGFDLFKELKKTNDGNIFFSFVGILTAIGMVLLGTRGATASQLEEVFHSE    60
NOV2e            ------------------------------------------------GSSQLEEVFHSE    12
gi|8393956|ref|  MDSLGAVSTRLGFDLFKELKKTNDGNIFFSFVGILTAIGMVLLGTRGARASQLEEVFHSE    60
gi|6018510|emb|  MDSLGAVSTRLGFDLFKELKKTNDGNIFFSFVGILTAIGMVLLGTRGARASQLEEVFHSE    60
gi|7522623|pir|  MDSLGAVSTRLGFDLFKELKKTNDGNIFFSFVGILTAIGMVLLGTRGARASQLEEVFHSE    60
gi|9301227|emb|  MDSLGAVNTRLGFDLFKELKKTNDGNIFFSFVGILTAIGMVLLGTRGARASQLEEVFHSE    60
gi|266995|sp|P2  MNSLSEAKTKFMFDLFQQFRKSKNNIFYSFKSITSASGMVLLGAKDNRAQQKKKVLHFD    60
```

TABLE 2L-continued

ClustalW Analysis of NOV2

```
                        70         80         90        100        110        120
                 ....|....|....|....|....|....|....|....|....|....|....|....|
NOV2a            KETKSSRTKAEEKEVRRIKAEGKEIENTEAVHQQFQKFLTEISKLTNDYELNITNRLFGE    120
NOV2b            KETKSSRTKAEEKEVRRIKAEGKEIENTEAVHQQFQKFLTEISKLTNDYELNITNRLFGE    120
NOV2c            KETKSSRTKAEEKEVRRIKAEGKEIENTEAVHQQFQKFLTEISKLTNDYELNITNRLFGE    120
NOV2d            KETKSSRTKAEEKEVRRIKAEGKEIENTEAVHQQFQKFLTEISKLTNDYELNITNRLFGE    120
NOV2e            KETKSSRTKAEEKEVRRIKAEGKEIENTEAVHQQFQKFLTEISKLTNDYELNITNRLFGE     72
gi|8393956|ref|  KETKSSRTKAEEKEV--------ENTEAVHQQFQKFLTEISKLTNDYELNITNRLFGE    111
gi|6018510|emb|  KETKSSRTKAEEKE---------IENTEAVHQQFQKFLTEISKLTNDYELNITNRLFGE    110
gi|7522623|pir|  KETKSSRTKAEEKEV--------ENTEAVHQQFQKFLTEISKLTNDYELNITNRLFGE    111
gi|9301227|emb|  KETKSSRTKAEEKEV--------ENTEAVHQQFQKFLTEISKLTNDYELNITNRLFGE    111
gi|266995|sp|P2  GVTKNITGKAATYHV--------RRSGNVHHQFQKLLTEFDKSTKAYELKIANRLFGE    110

130        140        150        160        170        180
                 ....|....|....|....|....|....|....|....|....|....|....|....|
NOV2a            KTYLFLQKYLDYVEKYYHASLEPVDFVNAADESRKKINSWVESKTNEKIKDLFPDGSISS    180
NOV2b            KTYLFLQKYLDYVEKYYHASLEPVDFVNAADESRKKINSWVESKTNEKIKDLFPDGSISS    180
NOV2c            KTYLFLQKYLDYVEKYYHASLEPVDFVNAADESRKKINSWVESKTNEKIKDLFPDGSISS    180
NOV2d            KTYLFLQKYLDYVEKYYHASLEPVDFVNAADESRKKINSWVESKTNE---------VETE    171
NOV2e            KTYLFLQKYLDYVEKYYHASLEPVDFVNAADESRKKINSWVESKTNEKIKDLFPDGSISS    132
gi|8393956|ref|  KTYLFLQKYLDYVEKYYHASLEPVDFVNAADESRKKINSWVESKTNEKIKDLFPDGSISS    171
gi|6018510|emb|  KTYLFLQKYLDYVEKYYHASLEPVDFVNAADESRKKINSWVESKTNEKIKDLFPDGSISS    170
gi|7522623|pir|  KTYLFLQKYLDYVEKYYHASLEPVDFVNAADESRKKINSWVESKTNEKIKDLFPDGSISS    171
gi|9301227|emb|  KTYLFLQKYLDYVEKYYHASLEPVDFVNAADESRKKINSWVESKTNEKIKDLFPDGSISS    171
gi|266995|sp|P2  KTYLFLQDYLDAKRKFYQTSVESVDFANAPEESRKKINSWVESSTNEKIKNLIPEGNIGS    170

190        200        210        220        230        240
                 ....|....|....|....|....|....|....|....|....|....|....|....|
NOV2a            STKLVLVNMVYFKGQWDREFKKENTKEEKFWMNKSTSKSVQMMTQSHSFSFTFLEDLQAK    240
NOV2b            STKLVLVNMVYFKGQWDR FKKENTKEEKFWMNKSTSKSVQMMTQSHSFSFTFLEDLQAK    240
NOV2c            STKLVLVNMVYFKGQWDREFKKENTKEEKFWMNKSTSKSVQMMTQSHSFSFTFLEDLQAK    240
NOV2d            AQRV--------------------------------------------------------    175
NOV2e            STKLVLVNMVYFKGQWDREFKKENTKEEKFWMNKSTSKSVQMMTQSHSFSFTFLEDLQAK    192
gi|8393956|ref|  STKLVLVNMVYFKGQWDREFKKENTKEEKFWMNKSTSKSVQMMTQSHSFSFTFLEDLQAK    231
gi|6018510|emb|  STKLVLVNMVYFKGQWDREFKKENTKEEKFWMNKSTSKSVQMMTQSHSFSFTFLEDLQAK    230
gi|7522623|pir|  STKLVLVNMVYFKGQWDREFKKENTKEEKFWMNKSTSKSVQMMTQSHSFSFTFLEDLQAK    231
gi|9301227|emb|  STKLVLVNMVYFKGQWDREFKKENTKEEKFWMN---------------------------    204
gi|266995|sp|P2  MTILVLVNASYFKGQWEKKFNKEDTKEEKFWPNKNTYKSIQMMRQYTSFHFASLELVQAK    230

250        260        270        280        290        300
                 ....|....|....|....|....|....|....|....|....|....|....|....|
NOV2a            ILGIPYKNNDLSMGVLLPNDIDGLEKIIDKISPEKLVEWTSFGHMEERKVNLHLPRFEVE    300
NOV2b            ILGIPYKNNDLSMGVLLPNDIDGLEKIIDKISPEKLVEWTSFGHMEERKVNLHLPRFEVE    300
NOV2c            ILGIPYKNNDLSMGVLLPNDIDGLEKIIDKISPEKLVEWTSFGHMEERKVNLHLPRFEVE    300
NOV2d            ------------------------------------------------------------    175
NOV2e            ILGIPYKNNDLSMGVLLPNDIDGLEKIIDKISPEKLVEWTSFGHMEERKVNLHLPRFEVE    252
gi|8393956|ref|  ILGIPYKNNDLSMGVLLPNDIDGLEKIIDKISPEKLVEWTSFGHMEERKVNLHLPRFEVE    291
gi|6018510|emb|  ILGIPYKNNDLSMGVLLPNDIDGLEKIIDKISPEKLVEWTSFGHMEERKVNLHLPRFEVE    290
gi|7522623|pir|  ILGIPYKNNDLSMGVLLPNDIDGLEKIIDKISPEKLVEWTSFGHMEERKVNLHLPRFEVE    291
gi|9301227|emb|  -----------------------KIIDKISPEKLVEWTSFGHMEERKVNLHLPRFEVE    239
gi|266995|sp|P2  VLEIPYKGKDLSMIVLLPNEIDGLSKEEKKTAEKLMEWTSLQNMRETRVSLHLPRFKVE    290

310        320        330        340        350        360
                 ....|....|....|....|....|....|....|....|....|....|....|....|
NOV2a            DGYDLEAVLAAMGMGDAFSEHDADYSGMSSGSGLYAQKFLHSSFVAVTEEGTEAAAATGI    360
NOV2b            DSYDLEAVLAAMGMGDAFSEHDADYSGMSSGSGLYAQKFLHSSFVAVTEEGTEAAAATGI    360
NOV2c            DSYDLEAVLAAMGMGDAFSEHDADYSGMSSGSGLYAQKFLHSSFVAVTEEGTEAAAATGI    360
NOV2d            ------------------------------------------------------------    175
NOV2e            DSYDLEAVLAAMGMGDAFSEHDADYSGMSSGSGLYAQKFLHSSFVAVTEEGTEAAAATGI    312
gi|8393956|ref|  DGYDLEAVLAAMGMGDAFSEHDADYSGMSSGSGLYAQKFLHSSFVAVTEEGTEAAAATGI    351
gi|6018510|emb|  DGYDLEAVLAAMGMGDAFSEHDADYSGMSSGSGLYAQKFLHSSFVAVTEEGTEAAAATGI    350
gi|7522623|pir|  DSYDLEAVLAAMGMGDAFSEHDADYSGMSSGSGLYAQKFLHSSFVAVTEEGTEAAAATGI    351
gi|9301227|emb|  DGYDLEAVLAAMGMGDAFSEHDADYSGMSSGSGLYAQKFLHSSFVAVTEEGTEAAAATGI    299
gi|266995|sp|P2  DSYDLEDTLRTMGMVDIFKG-DADLSGMEGSRGLVLSGVLHKAFVEVTEEGAEAAAATAW    349

370        380        390        400
                 ....|....|....|....|....|....|....|....|
NOV2a            G-FTVTSAPGHENVHCNHPFLFFIRHNESNSILFFGRFSSP--    400
NOV2b            G-FTVTSAPGHENVHCNHPFLFFIRHNESNSILFFGRFSSP--    400
NOV2c            G-FTVTSAPGHENVHCNHPFLFFIRHNESNSILFFGRFSSP--    400
NOV2d            ------------------------------------------    175
NOV2e            G-FTVTSAPGHENVHCNHPFLFFIRHNESNSILFFGRFSSPLE    354
gi|8393956|ref|  G-FTVTSAPGHENVHCNHPFLFFIRHNESNSILFFGRFSSP--    391
gi|6018510|emb|  G-FTVTSAPGHENVHCNHPFLFFIRHNESNSILFFGRFSSP--    390
gi|7522623|pir|  G-FTVTSAPGHENVHCNHPFLFFIRHNESNSILFFGRFSSP--    391
gi|9301227|emb|  G-FTVTSAPGHENVHCNHPFLFFIRHNESNSILFFGRFSSP--    339
gi|266995|sp|P2  VGFGSSPASTNEEFHCNHPFLFFIRQNKTNSILFYGRFSSP--    390
```

Tables 2M–N lists the domain description from DOMAIN analysis results against NOV2a. This indicates that the NOV2a sequence has properties similar to those of other proteins known to contain this domain.

TABLE 2M

Domain Analysis of NOV2 gnl|Pfam|pfam00079, serpin, Serpin (S protease inhibitor). Structure
is a multi-domain fold containing a bundle of helices and a beta
sandwich. (SEQ ID NO:66)
CD-Length = 377 residues, 98.4% aligned
Score = 318 bits (816), Expect = 3e-88

```
Query:     3 SLGAVSTRLGFDLFKEL-KKTNDGNIFFSPVGILTAIGMVLLGTRGATASQLEEVFHSEK  61
             | + +      | |+||| ++  |  ||||||| | +|+ |+ ||  +| ||+|+ ||
Sbjct:     7 KLASANADFAFSLYKELVEQNPDKNIFFSPVSISSALAMLSLGAKGNTATQILEVLGFNL  66

Query:    62 ETKSSRIKAEEKEVVRIKAEGKEIENTEAVHQQFQKFLTEISKLTNDYELNITNRLFGEK 121
             |                      +|| ||  |  |+++    +|    |  || +|
Sbjct:    67 TETSE--------------------AEIHQGFQHLLQELNRPDTGLQLTTGNALFVDK  104

Query:   122 TYLFLQKYLDYVEKYYHASLEPVDFVNAADESRKKINSWVESKTNEKIKDLFPDGSISSS 181
             +   | ++|+ ++  | + +   ||| + +|++|+||  ||| ||  ||||| |  + |
Sbjct:   105 SLKLLDEFLEDSKRLYQSEVFSVDF-SDPEEAKKQINDWVEKKTQGKIKDLLKD--LDSD 161

Query:   182 TKLVLVNMVYFKGQWDREFKKENTKEEKFWMNKSTSKSVQMMTQSHSFSFTFLEDIQAKI 241
             | ||||| +|||+| + |   |+|| |  ++|  |+  |||   +| +   |+|   |+
Sbjct:   162 TVLVLVNYIYFKGKWKKPFDPELTEEEDFHVDKKTTVKVPMMNQLGTFYYFRDEELNCKV 221

Query:   242 LGIPYKNNDLSMFVLLPNDIDGLEKIIDKISPEKLVEWTSPGHMEERKVNLHLPRFEVED 301
             | +|||   |   ||  +|+|+++  ||++   +||| |+|      +|| |+| +|+| +|
Sbjct:   222 LELPYKGNATSMLFILPDEVGKLEQVEAALSPETLRKWLE--NMEPREVELYLPKFSIEG 279

Query:   302 GYDLEAVLAAMGMGDAFSEHKADYSGMSSGSGLYAQKFLHSSFVAVTEEGTEAAAATGIG 361
             |||+ ||| +|+ | ||  +|| ||+|   |    | +| + + | ||||||||||||
Sbjct:   280 TYDLKDVLAKLGITDLFSN-QADLSGISEDEDLKVSKAVHKAVLEVDEEGTEAAAATGAI 338

Query:   362 FTVTSAPGHENVHCNHPFLFFIRHNESNSILFFGRFSSP                     400
             | |        + |||| |  + + |||| |+ +|
Sbjct:   339 IVPRSLPPELEFTADRPFLFLIYDDPTGSILFMGKVVNP                     377
```

TABLE 2N

Domain Analysis of NOV2 gnl|Smart|smart00093, SERPIN, SERine Proteinase INhibitors
(SEQ ID NO: 67)
CD-Length = 360 residues, 100.0% aligned
Score = 312 bits (800), Expect = 2e-86

```
Query:    13 FDLFKELKKTN-DGNIFFSPVGILTAIGMVLLGTRGATASQLEEVFHSEKETKSSRIKAE  71
             |||+||| + |  +  |||||| |||||| | +|+ |+ ||  +|+|+|+| ||      |
Sbjct:     1 FDLYKELAKESPDKNIFFSPVSISSALAMLSLGAKGSTATQILEVLGFNLTETSE-----  55

Query:    72 EKEVVRIKAEGKEIENTEAVHQQFQKFLTEISKLTNDYELNITNRLFGEKTYLFLQKYLD 131
             +|| ||  |  |  +++    |    | |+|+    |  +|+
Sbjct:    56 ----------------ADIHQGFQHLLHLLNRPDNKLQLKTANALFVDKSLKLLDSFLE   98

Query:   132 YVEKYYHASLEPVDFVNAADESRKKINSWVESKTNEKIKDLFPDGSISSSTKLVLVNMVY 191
             |+|  | ++  ||| + +|++|+||   ||+ || |||||   |   +  |+||||| +|
Sbjct:    99 DVKKLYGAEVQSVDFSDPAEEAKKQINDWVKKKTQGKIKDLLSD--LDPDTRLVLVNAIY 156

Query:   192 FKGQWDREFKKENTKEEKFWMNKSTSKSVQMMTQ-SHSFSFTFLEDLQAKILGIPYKNND 250
             |||+|   |||+|| |+++++|+  | ||+   +|  + +   ++  +|+| |
Sbjct:   157 FKGKWKTPFDPENTREEDFYVDETTTVKVPMMSQTGRTFRYGRDEELNCQVLELPYKGN- 215

Query:   251 LSMFVLLPNDIDGLEKIIDKISPEKLVEWTSPGHMEERKVNLHLPRFEVEDGYDLEAVLA 310
             || ++||++ |||  +  ++|| | +|| + +| | | ||+|+|++|+++| |||+ ||
Sbjct:   216 ASMLIILPDEG-LETVEKALTPETLKKWTK--SLTKRSVELYLPKFKLEISYDLKDVLE 272

Query:   311 AMGMGDAFSEHKADYSGMSSGSGLYAQKFLHSSFVAVTEEGTEAAAATGIGFTVTSAPGH 370
             +|+ | ||   |||  ||+|  | | +|+ + + | ||||||||||||+   | |
Sbjct:   273 KLGITDLFSN-KADLSGISEDKDLKVSKVVHKAFLEVNEEGTEAAAATGVIIVPRSLP-P 330

Query:   371 ENVHCNHPFLFFIRHNESNSILFFGRFSSP                              400
             | |||| ||  + + |||| |+ +|
Sbjct:   331 PEFKANRPFLFLIRDNPTGSILFMGKVVNP                              360
```

Proteolysis is the key feature of programmed cell death. Extracellular proteinases can activate cell surface receptors which trigger apoptosis, and the effector machinery requires the activation and activity of numerous intracellular proteinases (primarily caspases). Effective control of proteolysis is essential for homeostasis and can occur at two levels:

regulation of proteinase activation, and regulation of the activated proteinase. The serpins, a family of proteins that inhibit chymotrypsin-like serine proteinases, control activated proteinases and several have been implicated in the regulation of cell death. Hurpin is a novel serine proteinase inhibitor recently cloned by Abts HF et al. (1999, J. Mol. Biol., Vol. 293:29–39). It has nearly 59% amino acid identity with the squamous cell carinoma antigent (SCCA1) and squamous cell carcinoma antigen 2 (SCCA2). Expression of hurpin appears to be related to the activation or proliferation state of keratinocytes.

The disclosed NOV2 nucleic acid of the invention encoding a Human Hurpin/Pi 13-like protein includes the nucleic acid whose sequence is provided in Tables 2A, 2C, 2E, 2G or a fragment thereof. The invention also includes a mutant or variant nucleic acid any of whose bases may be changed from the corresponding base shown in Tables 2A, 2C, 2E, or, 2G while still encoding a protein that maintains its Human Hurpin/Pi 13-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 3 percent of the bases may be so changed.

The disclosed NOV2 protein of the invention includes the Human Hurpin/PI 13-like protein whose sequence is provided in Tables 2B, 2D, 2F, or 2H. The invention also includes a mutant or variant protein any of whose residues may be changed from the corresponding residue shown in Table 2B, 2D, 2F, or 2H while still encoding a protein that maintains its Human Hurpin/PI 13-like activities and physiological functions, or a functional fragment thereof. In the mutant or variant protein, up to about 48 percent of the residues may be so changed.

The NOV2 nucleic acids and proteins of the invention are useful in potential therapeutic applications implicated in Colorectal cancer; Combined factor V and VIII deficiency; Cone-rod retinal dystrophy-1; Leukemia/lymphoma, B-cell, 2; Lymphoma/leukemia, B-cell, variant; Protoporphyria, erythropoietic; Protoporphyria, erythropoietic, recessive, with liver failure; Obesity, autosomal dominant; Osteosarcoma; cancer, skin psoriasis, and/or other pathologies and disorders.

NOV2 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. The disclosed NOV2 protein has multiple hydrophilic regions, each of which can be used as an immunogen. These novel proteins can be used in assay systems for functional analysis of various human disorders, which are useful in understanding of pathology of the disease and development of new drug targets for various disorders.

NOV3

NOV3 includes three novel Set Binding Factor (SBF11 like proteins disclosed below. The disclosed sequences have been named NOV3a and NOV3b.

NOV3a

A disclosed NOV3a nucleic acid of 5316 nucleotides (also referred to as CG56019-01) encoding a novel Set Binding Factor (SBF1)-like protein is shown in Table 3A. An open reading frame was identified beginning with a ATT initiation codon at nucleotides 3–5 and ending with a TGA codon at nucleotides 5172–5174. The start and stop codons are in bold letters, and the 5' and 3' untranslated regions are underlined. Because the start codon is not a traditional initiation codon, NOV3 could be a partial open reading frame that extends further in the 5' direction.

TABLE 3A

NOV3a Nucleotide Sequence (SEQ ID NO:17)

G<u>A</u>ATTCGGCACGAGGTCTTCCTGTCCCGGAGCTACCAGCGGCTCGCCGATGCCTGTAGGGGCCTCCTGGCA

CTGCTGTTTCCTCTCAGATACAGCTTCACCTATGTGCCCATCCTGCCGGCTCAGCTGCTGGAGGTCCTCAG

CACACCCACGCCCTTCATCATTGGGGTCAACGCGGCCTTCCAGGCAGAGACCCAGGAGCTGCTCGATGTGA

TTGTTGCTGATCTGGATGGAGGGACGGTCACCATTCCTGAGTGTGTGCACATTCCACCCTTGCCAGAGCCA

CTGCAGAGTCAGACGCACAGTGTGCTGAGCATGGTCCTGGACCCGGAGCTGGAGTTGGCTGACCTCGCCTT

CCCTCCGCCCACGACATCCACCTCCTCCCTGAAGATGCAGGACAAGGAGCTGCGCGCGGTCTTCCTGCGGC

TGTTCGCTCAGCTGCTGCAGGGCTATCGCTGGTGCCTGCACGTCGTGCGCATCCACCCGGAGCCTGTCATC

CGCTTCCATAAGGCAGCCTTCCTGGGGCAGCGTGGGCTGGTAGAGGACGATTTCCTGATGAAGGTGCTGGA

GGGCATGGCCTTTGCTGGCTTTGTGTCAGAGCGTGGGGTCCCATACCGCCCTACGGACCTGTTCGATGAGC

TGGTGGCCCACGAGGTGGCAAGGATGCGGGCGGATGAGAACCACCCCCAGCGTGTCCTGCGTCACGTCCAG

GAACTGGCAGAGCAGCTCTACAAGAACGAGAACCCGTACCCAGCCGTGGCGATGCACAAGGTACAGAGGCC

CGGTGAGAGCAGCCACCTGCGACGGGTGCCCCGACCCTTCCCCCGGCTGGATGAGGGCACCGTGCAGTGGA

TCGTGGACCAGGCTGCAGCCAAGATGCAGGGTGCACCCCCAGCTGTGAAGGCCGAGAGGAGGACCACCGTG

TABLE 3A-continued

NOV3a Nucleotide Sequence (SEQ ID NO:17)

```
CCCTCAGGGCCCCCCATGACTGCCATACTGGAGCGGTGCAGTGGGCTGCATGTCAACAGCGCCCGGCGGCT
GGAGGTTGTGCGCAACTGCATCTCCTACGTGTTTGAGGGGAAAATGCTTGAGGCCAAGAAGCTGCTCCCAG
CCGTGTTGAGGGCCCTGAAGGGGCGAGTTGCCCGCCGCTGCCTCGCCCAGGAGCTGCACCTGCATGTGCAG
CAGAACCGTGCGGTCCTGGACCACCAGCAGTTTGACTTTGTCGTCCGTATGATGAACTGCTGCCTGCAGGA
CTGCACTTCTCTGGACGAGCATGGCATTGCGGCGGCTCTGCTGCCTCTGGTCACAGCCTTCTGCCGGAAGC
TGAGCCCGGGGTGACGCAGTTTGCATACAGCTGTGTGCAGGAGCACGTGGTGTGGAGCACGCCACAGTTC
TGGGAGGCCATGTTCTATGGGGATGTGCAGACTCACATCCGGGCCCTCTACCTGGAGCCCACGGAGGACCT
GGCCCCCGCCCAGGAGGTTGGGGAGGCACCTTCCCAGGAGGACGAGCGCTCTGCCCTAGACGTGGCTTCTG
AGCAGCGGCGCTTGTGGCCAACTCTGAGTCGTGAGAAGCAGCAGGAGCTGGTGCAGAAGGAGGAGAGCACG
GTGTTCAGCATGGCCATCCACTATGCCACCGCATGAGCTACCTCCTCCTGCCCCTGGACAGCAGGCAAGAG
CCGCCTACTTCGGGAGCGTGCCGGGCTGGCGACCTGGAGAGCGCCAGCAACAGCCTGGTCACCAACAGCA
TGGCTGGCAGTGTGGCCGAGAGCTATGACACGGAGAGCGGCTTCGAGGATGCAGAGACCTGCGACGTAGCT
GGGGCTGTGGTCCGCTTCATCAACCGCTTTGTGGACAAGGTCTGCACGGAGAGTGGGGTCACCAGCGACCA
CCTCAAGGGGCTGCATGTCATGGTGCCAGACATTGTCCAGATGCACATCGAGACCCTGGAGGCCGTGCAGC
GGGAGAGCCGGAGGCTGCCGCCCATCCAGAAGCCCAAGCTGCTGCGGCCGCGCCTGCTGCCGGGTGAGGAG
TGTGTGCTGGACGGCCTGCGCGTCTACCTGCTGCCGGATGGGCGTGAGGAGGGCGCGGGGGGCAGTGCTGG
GGGACCAGCATTGCTCCCAGCTGAGGGCGCCGTCTTCCTCACCACGTACCGGGTCATCTTCACGGGGATGC
CCACGGACCCCCTGGTTGGGGAGCAGGTGGTGGTCCGCTCCTTCCCGGTGGCTGCGCTGACCAAGGAGAAG
CGCATCAGCGTCCAGACCCCTGTGGACCAGCTCCTGCAGGACGGGCTCCAGCTGCGCTCCTGCACATTCCA
TCAGCCCTGAAGCCCTCCGACCGCATGACCATGAGCAGCCTGGTGGAAAGGGCTTGCTGTCGCGACTACCA
AGCTGCGGTACCCGCCGGACATCAGGGCCACCTTTGCGTTCACCTTGGGCTCTGCCCACACACCTGGCCGG
CCACCGCGAGTCACCAAGGACAAGGGTCCTTCCCTCAGAACCCTGTCCCGGAACCTGGTCAAGAACGCCAA
GAAGACCATCGGGCGGCAGCATGTCACTCGCAAGAAGTACAACCCCCCCAGCTGGGAGCACCGGGGCCAGC
CGCCCCCTGAGACCGGAGGACGAGATCTCAGTGTCGGAGGAGCTGGAGCCCAGCACGCTGAGGCCCCGTCC
TCAGCCCTGAAGCCCTCCGACCGCATGACCATGAGCAGCCTGGTGGAAAGGGCTTGCTGTCGCGACTACCA
GCGCCTCGGTCTGGGCACCCTGAGCAGCAGCCTGAGCCGGGCCAAGTCTGAGCCCTTCCGCATTTCTCCGG
TCAACCGCATGTATGCCATCTGCCGCAGCTACCCAGGGCTGCTGATCGTGCCCCAGAGTGTCCAGGACAAC
GCCCTGCAGCGCGTGTCCCGCTGCTATCGCCAGAACCGCTTCCCCGTGGTCTGCTGGCGCAGCGAGCGGTC
CAAGGCGGTGCTGCTGCGCTCTGGAGGCCTGCATGGCAAAGGTGTCGTCGGCCTCTTCAAGGCCCAGAACG
CACCTTCTCCAGGCCAGTCCCAGGCGGACTCGAGTAGCCTGGAGCAGGAGAAGTACCTGCAGGCTGTGGTC
AGCTCCATGCCCCGCTACGCCGACGCGTCGGGACGCAACACGCTTAGCGGCTTCTCCTCAGCCCACATGGG
CAGTCACGTTCCCAGCCCAGAGCCAGGGTCACCACGCTGTCCAACCCCATGGCGGCCTCTGGCCTCCAGAC
GGACCGCACCCCGAGGTAAGTGGGGCAGTGTCCGGACCAGTGGACGCAGCAGTGGCCTTGGCACCGATGTG
GGCTCCCGGCTAGCTGGCAGAGACGCGCTGGCCCCACCCCAGGCCAACGGGGCCCTCCCGACCCGGGCTT
CCTGCGTCCGCAGCGAGCAGCCCTCTATATCCTTGGGGACAAAGCCCAGCTCAAGGGTGTGCGGTCAGACC
CCCTGCAGCAGTGGGAGCTGGTGCCCATTGAGGTATTCGAGGCACGGCAGGTGAAGGCTAGCTTCAAGAAG
CTGCTGAAAGCATGTGTCCCAGGCTGCCCCGCTGCTGAGCCCAGCCCAGCCTCCTTCCTGCGCTCACTGGA
GGACTCAGAGTGGCTGATCCAGATCCACAAGCTGCTGCAGGTGTCTGTGCTGGTGGTGGAGCTCCTGGATT
```

TABLE 3A-continued

NOV3a Nucleotide Sequence (SEQ ID NO:17)

CAGGCTCCTCCGTGCTGGTGGGCCTGGAGGATGGCTGGGACATCACCACCCAGGTGGTATCCTTGGTGCAG

CTGCTCTCAGACCCCTTCTACCGCACGCTGGAGGGCTTTCGCCTGCTGGTGGAGAAGGAGTGGCTGTCCTT

CGGCCATCGCTTCAGCCACCGTGGAGCTCACACCCTGGCCGGGCAGAGCAGCGGCTTCACACCCGTCTTCC

TGCAGTTCCTGGACTGCGTACACCAGGTCCACCTGCAGTTCCCCATGGAGTTTGAGTTCAGCCAGTTCTAC

CTCAAGTTCCTCGGCTACCACCATGTGTCCCGCCGTTTCCGGACCTTCCTGCTCGACTCTGACTATGAGCG

CATTGAGCTGGGGCTGCTGTATGAGGAGAAGGGGGAACGCAGGGGCCAGGTGCCGTGCAGGTCTGTGTGGG

AGTATGTGGACCGGCTGAGCAAGAGGACGCCTGTGTTCCACAATTACATGTATGCGCCCGAGGACGCAGAG

GTCCTGCGGCCCTACAGCAACGTGTCCAACCTGAAGGTGTGGGACTTCTACACTGAGGAGACGCTGGCCGA

GGCCCTCCCTATGACTGGGAACTGGCCCAGGGGCCCCCTGAACCCCCAGAGGAAGAACGGTCTGATGGAGG

CGTCCCCAGAGCAGCGCCGCGTGGTGTGGCCCTGTTACGACAGCTGCCCGCGGGCCCAGCCTGACGCCATC

TCACGCCTGCTGGAGGAGCTGCAGAGGCTGGAGACAGAGTTGGGCCAACCCGCTGAGCGCTGGAAGGACAC

CTGGGACCGGGTGAAGGCTGCACAGCGCCTCGAGGGCCGGCCAGACGGCCGTGGCACCCCTAGCTCCCTCC

TTGTGTCCACCGCACCCCACCACCGTCGCTCGCTGGGTGTGTACCTGCAGGAGGGGCCCGTGGGCTCCACC

CTGAGCCTCAGCCTGGACAGCGACCAGAGTAGTGGCTCAACCACATCCGGCTCCCGTCAGGCTGCCCGCCG

CAGCACCAGCACCCTGTACAGCCAGTTCCAGACAGCAGAGAGTGAGAACAGGTCCTACGAGGGCACTCTGT

ACAAGAAGGGGGCCTTCATGAAGCCTTGGAAGGCCCGCTGGTTCGTGCTGGACAAGACCAAGCACCAGCTG

CGCTACTACGACCACCGTGTGGACACAGAGTGCAAGGGTGTCATCGACTTGGCGGAGGTGGAGGCTGTGGC

ACCTGGCACGCCCACTATGGGTGCCCCTAAGACTGTGGACGAGAAGGCCTTCTTTGACGTGAAGACAACGC

GTCGCGTTTACAACTTCTGTGCCCAGGACGTGCCCTCGGCCCAGCAGTGGGTGGACCGGATCCAGAGCTGC

TGTCGGACGCCTGAGCCTCCCAGCCCTGCCCGGCTGCTCTGCTCTCGTTACCGACCACTAGGGGTGGCAGG

GCCGCCCGGCCATGTTTACAGCCCCCGCCCTCGACAGTACTGACCCCCGAGCCCCCAGCACTTGTGTGTA

CAGCCCCCGTCCCCGCCCCGCCCCGCCCGGCCCGCCCTAACTTATTTTGGCGTCACAGCTGAGATCCGTGC

CGGGAGGTGGCCAAGGTACAGCCCGCAATGGGCCTGTAAATAGTCCGGCCCCGTCAGCGTGTGCTGGTCCA

CGGGCTCAGGCGAGTTTCTAGAAAGAGTCTATATAAAGAGAGAACTAACGCCAAAAAAAAAA

The disclosed NOV3a nucleic acid sequence maps to the q13.3 region of chromosome 22 and has 3553 of 3902 bases (91%) identical to a gb:GENBANK-ID:HSU93181 lacc:U93181.1 mRNA from *Homo sapiens* (*Homo sapiens* nuclear dual-specificity phosphatase (SBF1) mRNA, partial cds) (E=0.0).

A disclosed NOV3a protein (SEQ ID NO:18) encoded by SEQ ID NO:17 has 1723 amino acid residues, and is presented using the one-letter code in Table 3B. Signal P, Psort and/or Hydropathy results predict that NOV3a does have a signal peptide, and is likely to be localized to the mitochondrial membrane space with a certainty of 0.5000. In other embodiments NOV3a is also likely to be localized to the microbody (peroxisome) with a certainty of 0.3000, to mitochondrial inner membrane with a certainty of 0.2187, or to the mitochondrial intermembrane space with a certainty of 0.2187. The most likely cleavage site for NOV3a is between positions 33 and 34, (SFT-YV).

TABLE 3B

Encoded NOV3a protein sequence (SEQ ID NO:18).

IRHEVFLSRSYQRLADACRGLLALLFPLRYSFTYVPILPAQLLEVLSTPTPFIIGVNAAFQAETQELLDVI

VADLDGGTVTIPECVHIPPLPEPLQSQTHSVLSMVLDPELELADLAFPPPTTSTSSLKMQDKELRAVFLRL

FAQLLQGYRWCLHVVRIHPEPVIRFHKAAFLGQRGLVEDDFLMKVLEGMAFAGFVSERGVPYRPTDLFDEL

VAHEVARMRADENHPQRVLRHVQELAEQLYKNENPYPAVAMHKVQRPGESSHLRRVPRPFPRLDEGTVQWI

VDQAAAKMQGAPPAVKAERRTTVPSGPPMTAILERCSGLHVNSARRLEVVRNCISYVFEGKMLEAKKLLPA

TABLE 3B-continued

Encoded NOV3a protein sequence (SEQ ID NO:18).

VLRALKGRVARRCLAQELHLHVQQNRAVLDHQQFDFVVRMMNCCLQDCTSLDEHGIAAALLPLVTAFCRKL

SPGVTQFAYSCVQEHVVWSTPQFWEAMFYGDVQTHIRALYLEPTEDLAPAQEVGEAPSQEDERSALDVASE

QRRLWPTLSREKQQELVQKEESTVFSQAIHYANRMSYLLLPLDSSKSRLLRERAGLGDLESASNSLVTNSM

AGSVAESYDTESGFEDAETCDVAGAVVRFINRFVDKVCTESGVTSDHLKGLHVMVPDIVQMHIETLEAVQR

ESRRLPPIQKPKLLRPRLLPGEECVLDGLRVYLLPDGREEGAGGSAGGPALLPAEGAVFLTTYRVIFTGMP

TDPLVGEQVVVRSFPVAALTKEKRISVQTPVDQLLQDGLQLRSCTFQLLKMAFDEEVGSDSAELFRKQLHK

LRYPPDIRATFAFTLGSAHTPGRPPRVTKDKGPSLRTLSRNLVKNAKKTIGRQHVTRKKYNPPSWEHRGQP

PPEDQEDEISVSEELEPSTLTPSSALKPSDRMTMSSLVERACCRDYQRLGLGTLSSSLSRAKSEPFRISPV

NRMYAICRSYPGLLIVPQSVQDNALQRVSRCYRQNRFPVVCWRSERSKAVLLRSGGLHGKGVVGLFKAQNA

PSPGQSQADSSSLEQEKYLQAVVSSMPRYADASGRNTLSGFSSAHMGSHVPSPRARVTTLSNPMAASASRR

TAPRGKWGSVRTSGRSSGLGTDVGSRLAGRDALAPPQANGGPPDPGFLRPQRAALYILGDKAQLKGVRSDP

LQQWELVPIEVFEARQVKASFKKLLKACVPGCPAAEPSPASFLRSLEDSEWLIQIHKLLQVSVLVVELLDS

GSSVLVGLEDGWDITTQVVSLVQLLSDPFYRTLEGFRLLVEKEWLSFGHRFSHRGAHTLAGQSSGFTPVFL

QFLDCVHQVHLQFPMEFEFSQFYLKFLGYHHVSRRFRTFLLDSDYERIELGLLYEEKGERRGQVPCRSVWE

YVDRLSKRTPVFHNYMYAPEDAEVLRPYSNVSNLKVWDFYTEETLAEALPMTGNWPRGPLNPQRKNGLMEA

SPEQRRVVWPCYDSCPRAQPDAISRRLEELQRLETELGQPAERWKDTWDRVKAAQRLEGRPDGRGTPSSLL

VSTAPHHRRSLGVYLQEGPVGSTLSLSLDSDQSSGSTTSGSRQAARRSTSTLYSQFQTAESENRSYEGTLY

KKGAFMKPWKARWFVLDKTKQLRYYDHRVDTECKGVIDLAEVEAVAPGTPTMGAPKPTVDEKAFFDVKTTR

RVYNFCAQDVPSAQQWVDRIQSCCRTPEPPSPARLLCSRYRPLGVAGPPRPCLQPRPSTVLSPEPPALVCT

APVPAPPRPAGPNLFWRHS

The disclosed NOV3a amino acid has 1047 of 1079 amino acid residues (97%) identical to, and 1052 of 1079 amino acid residues (97%) similar to, the 1697 amino acid residue ptnr:SPTREMBL-ACC:060228 protein from *Homo sapiens* (Human) (Nuclear Dual-Specificity Phosphatase) (E=0.0).

NOV3 is expressed in at least the following tissues: Adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. This information was derived by determining the tissue sources of the sequences that were included in the invention including but not limited to SeqCalling sources, Public EST sources, and/or RACE sources.

NOV3b

Is In the present invention, the target sequence identified previously, NOV3a, was subjected to the exon linking process to confirm the sequence. PCR primers were designed by starting at the most upstream sequence available, for the forward primer, and at the most downstream sequence available for the reverse primer. In each case, the sequence was examined, walking inward from the respective termini toward the coding sequence, until a suitable sequence that is either unique or highly selective was encountered, or, in the case of the reverse primer, until the stop codon was reached. Such primers were designed based on in silico predictions for the full length cDNA, part (one or more exons) of the DNA or protein sequence of the target sequence, or by translated homology of the predicted exons to closely related human sequences sequences from other species. These primers were then employed in PCR amplification based on the following pool of human cDNAs: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. Usually the resulting amplicons were gel purified, cloned and sequenced to high redundancy. The resulting sequences from all clones were assembled with themselves, with other fragments in CuraGen Corporation's database and with public ESTs. Fragments and ESTs were included as components for an assembly when the extent of their identity with another component of the assembly was at least 95% over 50 bp. In addition, sequence traces were evaluated manually and edited for corrections if appropriate. These procedures provide the sequence reported below, which is designated NOV3b. This differs from the previously identified sequence (NOV3a) by coding for 50 additional bases at 5' end that includes a signal peptide.

A disclosed NOV3b nucleic acid of 5740 nucleotides (also referred to as Curagen Accession No. CG56019-02) encoding a novel Set Binding Factor I-like protein is shown in Table 3C. An open reading frame was identified beginning with an ATG initiation codon at nucleotides 396–398 and ending with a TGA codon at nucleotides 2439–2441. A putative untranslated region downstream from the termination codon are underlined in Table 3C. The start and stop codons are in bold letters.

TABLE 3C

NOV3b nucleotide sequence (SEQ ID NO:19).

ACGCGTGTGGAGGATGCCACAGAGAGGGAGGAAGAGGGGGATGAGGGAGGCCAGACCCACCTGTCTCCCACA

GCACCTGCCCCATCTGCCCAGCTGTTTGCACCGAAGACGCTGGTACTGGTGTCGCGACTCGACCACACGGGG

GGGTTCAGGACCAGCCTTGGCCTCATCTATGCCATCCACGTGGAGGGCCTGAATGTGTGCCTGGAGAACGTG

ATTGGGAACCTGCTGACGTGCACTGTGCCCCTGGCTGGGGGCTCGCAGAGGACGATCTCTTTGGGGGCTGGT

GACCGGCAGGTCATCCAGACTCCACTGGCCGACTCGCTGCCCGTCAGCCGCTGCAGCGTGGCCCTGCTCTTC

CGCCAGCTAGGTGAGCCTGTCTGTCCCACCCCCGCATGGCTTCCCCTCGGGGACTGGTAGTTAGGGATGTGG

GTTCTCACTCTGCCTGGGTGGGGGCCCAGGGTCCTCTCCAAGCTTCTCTTCTTCCTTTAGGCATCACCAACG

TGCTGTCTTTGTTCTGTGCCGCCCTCACGGAGCACAAGGTTCTCTTCCTGTCCCGGAGCTACCAGCGGCTCG

CCGATGCCTGTAGGGGCCTCCTGGCACTGCTGTTTCCTCTCAGATACAGCTTCACCTATGTGCCCATCCTGC

CGGCTCAGCTGCTGGAGGTCCTCAGCACACCCACGCCCTTCATCATTGGGGTCAACGCGGCCTTCCAGGCAG

AGACCCAGGAGCTGCTCGATGTGATTGTTGCTGATCTGGATGGAGGGACGGTCACCATTCCTGAGTGTGTGC

ACATTCCACCCTTGCCAGAGCCACTGCAGAGTCAGACGCACAGTGTGCTGAGCATGGTCCTGGACCCGGAGC

TGGAGTTGGCTGACCTCGCCTTCCCTCCGCCCACGACATCCACCTCCTCCCTGAAGATGCAGGACAAGGAGC

TGCGCGCGGTCTTCCTGCGGCTGTTCGCTCAGCTGCTGCAGGGCTATCGCTGGTGCCTGCACGTCGTGCGCA

TCCACCCGGAGCCTGTCATCCGCTTCCATAAGGCAGCCTTCCTGGGCCAGCGTGGGCTGGTAGAGGACGATT

TCCTGATGAAGGTGCTGGAGGGCATGGCCTTTGCTGGCTTTGTGTCAGAGCGTGGGGTCCCATACCGCCCTA

CGGACCTGTTCGATGAGCTGGTGGCCCACGAGGTGGCAAGGATGCGGGCGGATGAGAACCACCCCCAGCGTG

TCCTGCGTCACGTCCAGGAACTGGCAGAGCAGCTCTACAAGAACGAGAACCCGTACCCAGCCGTGGCGATGC

ACAAGGTACAGAGGCCCGGTGAGAGCAGCCACCTGCGACGGGTGCCCCGACCCTTCCCCCGGCTGGATGAGG

GCACCGTGCAGTGGATCGTGGACCAGGCTGCAGCCAAGATGCAGGGTGCACCCCCAGCTGTGAAGGCCGAGA

GGAGGACCACCGTGCCCTCAGGGCCCCCCATGACTGCCATACTGGAGCGGTGCAGTGGGCTGCATGTCAACA

GCGCCCGGCGGCTGGAGGTTGTGCGCAACTGCATCTCCTACGTGTTTGAGGGGAAAATGCTTGAGGCCAAGA

AGCTGCTCCCAGCCGTGTTGAGGGCCCTGAAGGGGCGAGCTGCCCGCCGCTGCCTCGCCCAGGAGCTGCACC

TGCATGTGCAGCAGAACCGTGCGGTCCTGGACCACCAGCAGTTTGACTTTGTCGTCCGTATGATGAACTGCT

GCCTGCAGGACTGCACTTCTCTGGACGAGCATGGCATTGCGGCGGCTCTGCTGCCTCTGGTCACAGCCTTCT

GCCGGAAGCTGAGCCCGGGGTGACGCAGTTTGCATACAGCTGTGTGCAGGAGCACGTGGTGTGGAGCACGCG

CACAGTTCTGGGAGGCCATGTTCTATGGGGATGTGCAGACTCACATCCGGGCCCTCTACCTGGAGCCCACGG

AGGACCTGGCCCCCGCCCAGGAGGTTGGGGAGGCACCTTCCCAGGAGGACGAGCGCTCTGCCCTAGACGTGG

CTTCTGAGCAGCGGCGCTTGTGGCCAACTCTGAGTCGTGAGAAGCAGCAGGAGCTGGTGCAGAAGGAGGAGA

GCACGGTGTTCAGCCAGGCCATCCACTATGCCAACCGCATGAGCTACCTCCTCCTGCCCCTGGACAGCAGCA

AGAGCCGCCTACTTCGGGAGCGTGCCGGGCTGGGCGACCTGGAGAGCGCCAGCAACAGCCTGGTCACCAACA

GCATGGCTGGCAGTGTGGCCGAGAGCTATGACACGGAGAGCGGCTTCGAGGATGCAGAGACCTGCGACGTAG

CTGGGGCTGTGGTCCGCTTCATCAACCGCTTTGTGGACAAGGTCTGCACGGAGAGTGGGGTCACCAGCGACC

ACCTCAAGGGGCTGCATGTCATGGTGCCAGACATTGTCCAGATGCACATCGAGACCCTGGAGGCCGTGCAGC

GGGAGAGCCGGAGGCTGCCGCCCATCCAGAAGCCCAAGCTGCTGCGGCCGCGCCTGCTGCCGGGTGAGGAGT

GTGTGCTGGACGGCCTGCGCGTCTACCTGCTGCCGGATGGGCGTGAGGAGGGCGCGGGGGGCAGTGCTGGGG

TABLE 3C-continued

NOV3b nucleotide sequence (SEQ ID NO:19).

GACCAGCATTGCTCCCAGCTGAGGGCGCCGTCTTCCTCACCACGTACCGGGTCATCTTCACGGGGATGCCCA
CGGACCCCCTGGTTGGGGAGCAGGTGGTGGTCCGCTCCTTCCCGGTGGCTGCGCTGACCAAGGAGAAGCGCA
TCAGCGTCCAGACCCCTGTGGACCAGCTCCTGCAGGACGGGCTCCAGCTGCGCTCCTGCACATTCCAGCTGC
TGAAAATGGCCTTTGACGAGGAGGTGGGGTCTGACAGCGCCGAGCTCTTCCGTAAGCAGCTGCATAAGCTGC
GGTACCCGCCGGACATCAGGGCCACCTTTGCGTTCACCTTGGGCTCTGCCCACACACCTGGCCGGCCACCGC
GAGTCACCAAGGACAAGGGTCCTTCCCTCAGAACCCTGTCCCGGAACCTGGTCAAGAACGCCAAGAAGACCA
TCGGGCGGCAGCATGTCACTCGCAAGAAGTACAACCCCCCCAGCTGGGAGCACCGGGGCCAGCCGCCCCCTG
AGGACCAGGAGGACGAGATCTCAGTGTCGGAGGAGCTGGAGCCCAGCACGCTGACCCCGTCCTCAGCCCTGA
AGCCCTCCGACCGCATGACCATGAGCAGCCTGGTGGAAAGGGCTTGCTGTCGCGACTACCAGCGCCTCGGTC
TGGGCACCCTGAGCAGCAGCCTGAGCCGGGCCAAGTCTGAGCCCTTCCGCATTTCTCCGGTCAACCGCATGT
ATGCCATCTGCCGCAGCTACCCAGGGCTGCTGATCGTGCCCCAGAGTGTCCAGGACAACGCCCTGCAGCGCG
TGTCCCGCTGCTACCGCCAGAACCGCTTCCCCGTGGTCTGCTGGCGCAGCGGGCGGTCCAAGGCGGTGCTGC
TGCGCTCTGGAGGCCTGCATGGCAAAGGTGTCGTCGGCCTCTTCAAGGCCCAGAACGCACCTTCTCCAGGCC
AGTCCCAGGCGGACTCGAGTAGCCTGGAGCAGGAGAAGTACCTGCAGGCTGTGGTCAGCTCCATGCCCCGCT
ACGCCGACGCGTCGGGACGCAACACGCTTAGCGGCTTCTCCTCAGCCCACATGGGCAGTCACGGTAAGTGGG
GCAGTGTCCGGACCAGTGGACGCAGCAGTGGCCTTGGCACCGATGTGGGCTCCCGGCTAGCTGGCAGAGACG
CGCTGGCCCCACCCCAGGCCAACGGGGCCCTCCCGACCCGGGCTTCCTGCGTCCGCAGCGAGCAGCCCTCT
ATATCCTTGGGGACAAAGCCCAGCTCAAGGGTGTGCGGTCAGACCCCCTGCAGCAGTGGGAGCTGGTGCCCA
TTGAGGTATTCGAGGCACGGCAGGTGAAGGCTAGCTTCAAGAAGCTGCTGAAAGCATGTGTCCCAGGCTGCC
CCGCTGCTGAGCCCAGCCCAGCCTCCTTCCTGCGCTCACTGGAGGACTCAGAGTGGCTGATCCAGATCCACA
AGCTGCTGCAGGTGTCTGTGCTGGTGGTGGAGCTCCTGGATTCAGGCTCCTCCGTGCTGGTGGGCCTGGAGG
ATGGCTGGGACATCACCACCCAGGTGGTATCCTTGGTGCAGCTGCTCTCAGACCCCTTCTACCGCACGCTGG
AGGGCTTTCGCCTGCTGGTGGAGAAGGAGTGGCTGTCCTTCGGCCATCGCTTCAGCCACCGTGGAGCTCACA
CCCTGGCCGGGCAGAGCAGCGGCTTCACACCCGTCTTCCTGCAGTTCCTGGACTGCGTACACCAGGTCCACC
TGCAGTTCCCCATGGAGTTTGAGTTCAGCCAGTTCTACCTCAAGTTCCTCGGCTACCACCATGTGTCCCGCC
GTTTCCGGACCTTCCTGCTCGACTCTGACTATGAGCGCATTGAGCTGGGGCTGCTGTATGAGGAGAAGGGGG
AACGCAGGGGCCAGGTGCCGTGCAGGTCTGTGTGGGAGTATGTGGACCGGCTGAGCAAGAGGACGCCTGTGT
TCCACAATTACATGTATGCGCCCGAGGACGCAGAGGTCCTGCGGCCCTACAGCAACGTGTCCAACCTGAAGG
TGTGGGACTTCTACACTGAGGAGACGCTGGCCGAGGGCCCTCCCTATGACTGGGAACTGGCCCAGGGGCCCC
CTGAACCCCAGAGGAAGAACGGTCTGATGGAGGCGCTCCCCAGAGCAGGCGCCGCGTGGTGTGGCCCTGTT
ACGACAGCTGCCCGCGGGCCCAGCCTGACGCCATCTCACGCCTGCTGGAGGAGCTGCAGAGGCTGGAGACAG
AGTTGGGCCAACCCGCTGAGCGCTGGAAGGACACCTGGGACCGGGTGAAGGCTGCACAGCGCCTCGAGGGCC
GGCCAGACGGCCGTGGCACCCCTAGCTCCCTCCTTGTGTCCACCGCACCCCACCACCGTCGCTCGCTGGGTG
TGTACCTGCAGGAGGGCCCGTGGGCTCCACCCTGAGCCTCAGCCTGGACAGCGACCAGAGTAGTGGCTCAA
CCACATCCGGCTCCCGTCAGGCTGCCCGCCGCAGCACCAGCACCCTGTACAGCCAGTTCCAGACAGCAGAGA
GTGAGAACAGGTCCTACGAGGGCACTCTGTACAAGAAGGGGGCCTTCATGAAGCTTGGAAGGCCCGCTGGT
TCGTGCTGGACAAGACCAAGCACCAGCTGCGCTACTACGACCACCGTGTGGACACAGAGTGCAAGGGTGTCA
TCGACTTGGCGGAGGTGGAGGCTGTGGCACCTGGCACGCCCACTATGGGTGCCCCTAAGACCGTGGACGAGA
AGGCCTTCTTTGACGTGAAGACAACGCGTCGCGTTTACAACTTCTGTGCCCAGGACGTGCCCTCGGCCCAGC

TABLE 3C-continued

NOV3b nucleotide sequence (SEQ ID NO:19).

AGTGGGTGGACCGGATCCAGAGCTGCCTGTCGGACGCCTGAGCCTCCCAGCCCTGCCCGGCTGCTCTGCTTC

CGGTCGTTACCGACCACTAGGGGTGGTGTTGGGACACCTGGGCGAGATGTGAGGGTGGGCTCACTTGAGCCA

CTGAAACCAGCCAGGTCTTCCCTCAGGCCGGACAGATGGCGCCTGACCAAAGTTCCTGGCACCTGGAAAACC

CACAGCAGGGCACGAGTGACCTGAGAGGCCCACTCAGGCAGAAGAGACGCAAGCTGGGCCGTCCAACTGGTT

TCAACTGCCAGCTTTACCAATGCAGCATTTATTTTAAAATTAAATTAAATTA

In a search of public sequence databases, the NOV3b nucleic acid sequence, located on chromosome 11, has 4947 of 4963 bases (99%) identical to a gb:GENBANK-ID:HSU93181|acc:U93181.1 mRNA from Homo sapiens (Homo sapiens nuclear dual-specificity phosphatase (SBF1) mRNA, partial cds) (E=0.0). Public nucleotide databases include all GenBank databases and the GeneSeq patent database.

The disclosed NOV3b polypeptide (SEQ ID NO:20) encoded by SEQ ID NO:19 has 1681 amino acid residues and is presented in Table 3B using the one-letter amino acid code. Signal P, Psort and/or Hydropathy results predict that NOV3b has a signal peptide and is likely to be localized to the Golgi body with a certainty of 0.9000. In other embodiments, NOV3b may also be localized to the plasma membrane with a certainty of 0.7900, in the microbody (peroxisome) with a certainty of 0.3525, or in the endoplasmic reticulum (membrane) with a certainty of 0.2000. The most likely cleavage site for NOV3b is between positions 46 and 47, ALT-EH.

TABLE 3D

Encoded NOV3b protein sequence (SEQ ID NO:20)

MASPRGLVVRDVGSHSAWVGAQGPLQASLLPLGITNVLSLFCAALTEHKVLFLSRSYQRLADACRGLLALLF

PLRYSFTYVPILPAQLLEVLSTPTPFIIGVNAAFQAETQELLDVIVADLDGGTVTIPECVHIPPLPEPLQSQ

THSVLSMVLDPELELADLAFPPPTTSTSSLKMQDKELRAVFLRLFAQLLQGYRWCLHVVRIHPEPVIRFHKA

AFLGQRGLVEDDFLMKVLEGMAFAGFVSERGVPYRPTDLFDELVAHEVARMRADENHPQRVLRHVQELAEQL

YKNENPYPAVAMHKVQRPGESSHLRRVPRPFPRLDEGTVQWIVDQAAAKMQGAPPAVKAERRTTVPSGPPMT

AILERCSGLHVNSARRLEVVRNCISYVFEGKMLEAKKLLPAVLRALKGRAARRCLAQELHLHVQQNRAVLDH

QQFDFVVRMMNCCLQDCTSLDEHGIAAALLPLVTAFCRKLSPGVTQFAYSCVQEHVVWSTPQFWEAMFYGDV

QTHIRALYLEPTEDLAPAQEVGEAPSQEDERSALDVASEQRRLWPTLSREKQQELVQKEESTVFSQAIHYAN

RMSYLLLPLDSSKSRLLRERAGLGDLESASNSLVTNSMAGSVAESYDTESGFEDAETCDVAGAVVRFINRFV

DKVCTESGVTSDHLKGLHVMVPDIVQMHIETLEAVQRESRRLPPIQKPKLLRPRLLPGEECVLDGLRVYLLP

DGREEGAGGSAGGPALLPAEGAVFLTTYRVIFTGMPTDPLVGEQVVVRSFPVAALTKEKRISVQTPVDQLLQ

DGLQLRSCTFQLLKMAFDEEVGSDSAELFRKQLHKLRYPPDIRATFAFTLGSAHTPGRPPRVTKDKGPSLRT

LSRNLVKNAKKTIGRQHVTRKKYNPPSWEHRGQPPPEDQEDEISVSEELEPSTLTPSSALKPSDRMTMSSLV

ERACCRDYQRLGLGTLSSSLSRAKSEPFRISPVNRMYAICRSYPGLLIVPQSVQDNALQRVSRCYRQNRFPV

VCWRSGRSKAVLLRSGGLHGKGVVGLFKAQNAPSPGQSQADSSSLEQEKYLQAVVSSMPRYADASGRNTLSG

FSSAHMGSHGKWGSVRTSGRSSGLGTDVGSRLAGRDALAPPQANGGPPDPGFLRPQRAALYILGDKAQLKGV

RSDPLQQWELVPIEVFEARQVKASFKKLLKACVPGCPAAEPSPASFLRSLEDSEWLIQIHKLLQVSVLVVEL

LDSGSSVLVGLEDGWDITTQVVSLVQLLSDPFYRTLEGFRLLVEKEWLSFGHRFSHRGAHTLAGQSSGFTPV

FLQFLDCVHQVHLQFPMEFEFSQFYLKFLGYHHVSRRFRTFLLDSDYERIELGLLYEEKGERRGQVPCRSVW

EYVDRLSKRTPVFHNYMYAPEDAEVLRPYSNVSNLKVWDFYTEETLAEGPPYDWELAQGPPEPPEEERSDGG

APQSRRRVVWPCYDSCPRAQPDAISRLLEELQRLETELGQPAERWKDTWDRVKAAQRLEGRPDGRGTPSSLL

VSTAPHHRRSLGVYLQEGPVGSTLSLSLDSDQSSGSTTSGSRQAARRSTSTLYSQFQTAESENRSYEGTLYK

TABLE 3D-continued

Encoded NOV3b protein sequence (SEQ ID NO:20)

KGAFMKPWKARWFVLDKTKHQLRYYDHRVDTECKGVIDLAEVEAVAPGTPTMGAPKTVDEKAFFDVKTTRRV

YNFCAQDVPSAQQWVDRIQSCLSDA

A search of sequence databases reveals that the NOV3b amino acid sequence has 1631 of 1631 amino acid residues (100%) identical to, and 1631 of 1631 amino acid residues (100%) similar to, the 1631 amino acid residue ptnr:SPTREMBL-ACC:Q9UGB8 protein from Homo sapiens (Human) (DJ579N16.2 (Set Binding Factor 1)) (E=0.0). Public amino acid databases include the GenBank databases, SwissProt, PDB and PIR.

NOV3b is expressed in at least the following tissues: Adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. Expression information was derived from the tissue sources of the sequences that were included in the derivation of the sequence of CuraGen Ace. No. CG56019-02. The sequence is predicted to be expressed with a similar pattern to (GENBANK-ID: gb:GENBANK-ID:HSU93181|acc:U93181.1) a closely related Homo sapiens nuclear dual-specificity phosphatase (SBF1) mRNA, partial cds homolog.

NOV3a also has homology to the amino acid sequences shown in the BLASTP data listed in Table 3E.

TABLE 3E

BLAST results for NOV3a

| Gene Index/<br>Identifier | Protein/<br>Organism | Length<br>(aa) | Identity<br>(%) | Positives<br>(%) | Expect |
|---|---|---|---|---|---|
| gi\|3015538\|gb\|AAC39675.1\|<br>(U93181) | nuclear<br>dual-<br>specificity<br>phosphatase<br>[Homo<br>sapiens] | 1697 | 1578/1723<br>(91%) | 1578/1723<br>(91%) | 0.0 |
| gi\|6572379\|emb\|CAB63063.1\|<br>(AL096767) | dJ579N16.2<br>(SET binding<br>factor 1)<br>[Homo<br>sapiens] | 1631 | 1495/1653<br>(90%) | 1501/1653<br>(90%) | 0.0 |
| gi\|17485528\|ref\|XP_037447.2\|<br>(XM_037447) | SET binding<br>factor 1<br>[Homo<br>sapiens] | 1327 | 1015/1066<br>(95%) | 1016/1066<br>(95%) | 0.0 |
| gi\|12698077\|dbj\|BAB21857.1\|<br>(AB051553) | KIAA1766<br>protein<br>[Homo<br>sapiens] | 1123 | 544/934<br>(58%) | 683/934<br>(72%) | 0.0 |
| gi\|15292603\|gb\|AAK93570.1\|<br>(AY052146) | SD10541p<br>[Drosophila<br>melanogaster] | 1728 | 596/1574<br>(37%) | 859/1574<br>(53%) | 0.0 |

The homology of these sequences is shown graphically in the ClustalW analysis shown in Table 3F.

TABLE 3F

ClustalW Analysis of NOV3

```
1) NOV3a (SEQ ID NO:18)
2) NOV3b (SEQ ID NO:20)
3) gi|3015538|gb|AAC39675.1| (U93181) nuclear dual-specificity phosphatase[Homo sapiens]
   (SEQ ID NO:68)
4) gi|6572379|emb|CAB63063.1| (AL096767) dJ579N16.2 (SET binding factor 1) [Homo sapiens]
   (SEQ ID NO:69)
5) gi|17485528|ref|XP_037447.2| (XM_037447) SET binding factor 1 [Homo sapiens]
   (SEQ ID NO:70)
6) gi|12698077|dbj|BAB21857.1| (AB053553) KIAA1766 protein [Homo sapiens]
   (SEQ ID NO:71)
7) gi|15292603|gb|AAK93570.1| (AY052146) SD10541p [Drosophila melanogaster]
   (SEQ ID NO:72)
```

TABLE 3F-continued

ClustalW Analysis of NOV3

```
                              10        20        30        40        50        60
                     ....|....|....|....|....|....|....|....|....|....|....|....|
NOV3a                ------------------------------------------------------------    1
NOV3b                ------------------------------------------------------------    1
gi|3015538|gb|A      ------------------------------------------------------------    1
gi|6572379|emb|      ------------------------------------------------------------    1
gi|17485528|ref      MSAPSSSPRAAEPARAPRAAPRPSPWRGSRTTSCWWRSGRTRAGSGEGQGQILQRFPEKD   60
gi|12698077|dbj      ------------------------------------------------------RFPQKD    6
gi|15292603|gb|      ------------------------------------------------------------    1

70        80        90       100       110       120
                     ....|....|....|....|....|....|....|....|....|....|....|....|
NOV3a                ------------------------------------------------------------    1
NOV3b                ------------------------------------------------------------    1
gi|3015538|gb|A      ------------------------------------------------------------    1
gi|6572379|emb|      ------------------------------------------------------------    1
gi|17485528|ref      WEDNPFPQGIELFCQPSGWQLCPERNPPTFFVAVLTDINSERHYCACLTFWEPAEPSQET  120
gi|12698077|dbj      WDDTPFPQGIELFCQPGGWQLSRERKQPTFFVVVLTDIDSDRHYCDCLTFYEAEINLQGT   66
gi|15292603|gb|      ------------------------------------------------------------    1

130       140       150       160       170       180
                     ....|....|....|....|....|....|....|....|....|....|....|....|
NOV3a                ------------------------------------------------------------    1
NOV3b                ------------------------------------------------------------    1
gi|3015538|gb|A      ------------------------------------------------------------    1
gi|6572379|emb|      ------------------------------------------------------------    1
gi|17485528|ref      TRVEDATEREEGDEGGQTHLSPTAPAPSAQLFAPKTLVLVSRLDHTEVFRNSLGLIYAI  180
gi|12698077|dbj      KKEEIEGEAKVSG------------LIQPAEVPAPKSLVLVSRLYYPEIPRACLGLIYTV  114
gi|15292603|gb|      ------------------------------------------------------------    1

190       200       210       220       230       240
                     ....|....|....|....|....|....|....|....|....|....|....|....|
NOV3a                ------------------------------------------------------------    1
NOV3b                ----------------MASPRGLVVRDVGSHSAWVGAQGPLQASLLP-------------   31
gi|3015538|gb|A      ------------------------------------------------------------    1
gi|6572379|emb|      ------------------------------------------------------------    1
gi|17485528|ref      HVEGLNVCLENVIGNLLTCTVPLAGGSQRTISLGAGDRQVIQTPLADSLPVSRCSVALLF  240
gi|12698077|dbj      YVDSLNVSLESLIANLCACLVPAAGGSQKLFSLGAGDRQLIQTPLHDSLPITGTSVALLF  174
gi|15292603|gb|      ------------------------------------------------------------    1

250       260       270       280       290       300
                     ....|....|....|....|....|....|....|....|....|....|....|....|
NOV3a                ------------------IRHEYFLSRSYQRLADACRGLIALIFPLRYSETYVPILPAQLL   43
NOV3b                --LGITNVLSLFCAALTEHKVLFLSRSYQRLADACRGLIALIFPLRYSETYVPILPAQLL   89
gi|3015538|gb|A      ------------------IRHEYFLSRSYQRLADACRGLIALIFPLRYSETYVPILPAQLL   43
gi|6572379|emb|      -------------DLFFKYTWN----------NFLHFQVELCIAAILSHAAR           29
gi|17485528|ref      RQLGITNVLSLFCAALTEHKVLFLSRSYQRLADACRGLIALIFPLRVSETYVPILPAQLL  300
gi|12698077|dbj      QQLGIQNVLSLFCAVLTENKVLFHSASEQRLIDACRALESIMFPLIRYSXPYIPILPAQLL  234
gi|15292603|gb|      ---------------MTENKILFLSRQYWHLTDSCRALWALMKPFRYTHVYIPILPAPLT   45

310       320       330       340       350       360
                     ....|....|....|....|....|....|....|....|....|....|....|....|
NOV3a                EVLSTPTPFIIGVNAAFQAETQELLDVIVADLDGGTVTIPECVH--IPPLPEPLQSQTHS  101
NOV3b                EVLSTPTPFIIGVNAAFQAETQELLDVIVADLDGGTVTIPECVH--IPPLPEPLQSQTHS  147
gi|3015538|gb|A      EVLSTPTPFIIGVNAAFQAETQELLDVIVADLDGGTVTIPECVH--IPPLPEPLQSQTHS  101
gi|6572379|emb|      PERIEAS--------G----SESR-----------VKPPH                     46
gi|17485528|ref      EVLSTPTPFIIGVNAAFQAETQELLDVIVADLDGGTVTIPECVH--IPPLPEPLQSQTHS  358
gi|12698077|dbj      EVLSSPTPFIIGVHSVFTDVHELLDVIRADLDGGTKKIPECIE--LSSLPRPLHQTQS   292
gi|15292603|gb|      EVLSTPTPFIVGIHSSLQTEITDLLDVIVVDLGGLVTIPESITPPVEILPSPLWEQTQD  105

370       380       390       400       410       420
                     ....|....|....|....|....|....|....|....|....|....|....|....|
NOV3a                VLSMVLDPELFEADLAFP---PPITSTSSSLKMQDKELRAVFLRLFAQLLQCYRWCLHVVR  158
NOV3b                VLSMVLDPELFEADLAFP---PPITSTSSSLKMQDKELRAVFLRLFAQLLQCYRWCLHVVR  204
gi|3015538|gb|A      VLSMVLDPELFEADLAFP---PPITSTSSSLKMQDKELRAVFLRLFAQLLQCYRWCLHVVR  158
gi|6572379|emb|      --------ENGNRSLETP---QPAASLPDNTMVT---------------HLEQKCCLVQR   80
gi|17485528|ref      VLSMVLDPELEEADLAFP---PPRTALSHSKVLDKEVRAVLRLFAQLFQCYRWSCLQIR  349
gi|12698077|dbj      ALSLILHPELEAADHAFP---PPRTALSHSKVLDKEVRAVLRLFAQLFQCYRWSCLQIR  349
gi|15292603|gb|      ILSMVLFPNLAQADLAFPRLERPSAIAKIDAQIDKELRAIFMRLFAQLLQFYRSCLTLKR  165

430       440       450       460       470       480
                     ....|....|....|....|....|....|....|....|....|....|....|....|
NOV3a                IHPEPVIRFHKAAFLGQRGLVEEDFLMKVLSGMAFAGFVSERGVPYRPDLFDELVAHEV  218
NOV3b                IHPEPVIRFHKAAFLGQRGLVEEDFLMKVLSGMAFAGFVSERGVPYRPDLFDELVAHEV  264
gi|3015538|gb|A      IHPEPVIRFHKAAFLGQRGLVEEDFLMKVLSGMAFAGFVSERGVPYRPDLFDELVAHEV  218
gi|6572379|emb|      ILEAWEANDHTQAAGGVR---------------RG-------------N----       101
gi|17485528|ref      IHPEPVIRFHKAAFLGQRGLVEEDFLMKVLSGMAFAGFVSERGVPYRPDLFDELVAHEV  475
gi|12698077|dbj      IHAEPVIHFHKTAFLGQRGLVDEDFLTKVLSGMAFAGFVSERGPPYRSCDLFDELVAFVN  409
gi|15292603|gb|      IHPKPVITFHKAGFLGARDLIESEPLFRVLRSMFFTTFVMERGPPWRSSDAMDELYSSMN  225
```

TABLE 3F-continued

ClustalW Analysis of NOV3

```
                          490       500       510       520       530       540
                    ....|....|....|....|....|....|....|....|....|....|....|....|
NOV3a               ARMRADENSPQRVLRHVQELAEQLYKNENPYPAVA-MHKVSRPGESSHLRRVPRPFPRLD       277
NOV3b               ARMRADENSPQRVLRHVQELAEQLYKNENPYPAVA-MHKVSRPGESSHLRRVPRPFPRLD       323
gi|3015538|gb|A     ARMRADENSPQRVLRHVQELAEQLYKNENPYPAVA-MHKVSRPGESSHLRRVPRPFPRLD       277
gi|6572379|emb|     -----------MGHLTRBANAVDN----------LERGPVQIHESEVIRGLPADC           136
gi|17485528|ref     ARMRADENSPQRVLRHVQELAEQLYKNENPYPAVA-MHKVSRPGESSHLRRVPRPFPRLD       534
gi|12698077|dbj     ERLKVSENRPVKMLRHVSELAEQLEKNENPHMA-FQKVPRPTEGSHLRVHILPFPEIN        468
gi|15292603|gb|     ELKKELAQNRNLRLTHEQELGRVLYENEGTLAHISYAQKVLRPPEGAFQRIHQPAFPRLS      285

550       560       570       580       590       600
                    ....|....|....|....|....|....|....|....|....|....|....|....|
NOV3a               EGIVQWIVDQAAAKMQCAPPAVKAER--RTTVPSGPPMTALLERCSGLHVNSARRLEVVR      335
NOV3b               EGIVQWIVDQAAAKMQCAPPAVKAER--RTTVPSGPPMTALLERCSGLHVNSARRLEVVR      381
gi|3015538|gb|A     EGIVQWIVDQAAAKMQCAPPAVKAER--RTTVPSGPPMTALLERCSGLHVNSARRLEVVR      335
gi|6572379|emb|     RGRWESFVPETLTET---------NR----------------------------------R   154
gi|17485528|ref     EGIVQWIVDQAAAKMQCAPPAVKAER--RTTVPSGPPMTALLERCSGLHVNSARRLEVVR      592
gi|12698077|dbj     EARVQEELEQENVAKNQAPPATRIER--KCVVPSGPPVSIMEKVE-TVFNSARRLEVVR       525
gi|15292603|gb|     SEKVELIQEGIRKN-GVPQRFHVTRNQHRITPMGPRLPEALLVRP-NVQNSARRLEVIR      343

610       620       630       640       650       660
                    ....|....|....|....|....|....|....|....|....|....|....|....|
NOV3a               NCISYVFEGKSLEASKLLPAVLRALKGRVARRCLAGELHLHVQQNRAVLDHQQFDEVVRM      395
NOV3b               NCISYVFEGKSLEASKLLPAVLRALKGRVARRCLAGELHLHVQQNRAVLDHQQFDEVVRM      441
gi|3015538|gb|A     NCISYVFEGKSLEASKLLPAVLRALKGRVARRCLAGELHLHVQQNRAVLDHQQFDEVVRM      395
gi|6572379|emb|     NTYMDLAFS-------------------------------DXQIQQ                   168
gi|17485528|ref     NCISYVFEGKSLEASKLLPAVLRALKGRVARRCLAGELHLHVQQNRAVLDHQQFDEVVRM      652
gi|12698077|dbj     NCISSVFENKSLEISKTLPAALRALKGKAARSCLIDELGHVQQNRAILDHQQFDESXRM      585
gi|15292603|gb|     ICVSYRFENKITDASKLLPAVLRTLMHRDARLILCREFFGSVHGNKAVLDEQQFEIVVRF    403

670       680       690       700       710       720
                    ....|....|....|....|....|....|....|....|....|....|....|....|
NOV3a               MNCCLQDCISLDEHGIAAALLPLVTAFCRKLSPGVLQFAYSCVQEHVMWSTPQFWEAMFY      455
NOV3b               MNCCLQDCISLDEHGIAAALLPLVTAFCRKLSPGVLQFAYSCVQEHVMWSTPQFWEAMFY      501
gi|3015538|gb|A     MNCCLQDCISLDEHGIAAALLPLVTAFCRKLSPGVLQFAYSCVQEHVMWSTPQFWEAMFY      455
gi|6572379|emb|     MTANFVDQFGFNDEEFADQDDNINAPRDR-----IAFINENIDAEEDSFS-----AALFE    218
gi|17485528|ref     MNCCLQDCISLDEHGIAAALLPLVTAFCRKLSPGVLQFAYSCVQEHVMWSTPQFWEAMFY      712
gi|12698077|dbj     MNCILQDCSSLEENIAAALLPLISAFYRKLAPGVLQFAYSCVQEHPIWINQQFWETTFY      645
gi|15292603|gb|     MNKALQKSSGFDENTYAAALLPMSTIFCRKLSTGVVQFAYHSTQSHASWKNLQFWESTEF    463

730       740       750       760       770       780
                    ....|....|....|....|....|....|....|....|....|....|....|....|
NOV3a               GDVQTHIRALYLEPTED-LAPAQEVGHAPSQE--DERSALDVASEQRRLWPTLSPEKQQE      512
NOV3b               GDVQTHIRALYLEPTED-LAPAQEVGHAPSQE--DERSALDVASEQRRLWPTLSPEKQQE      558
gi|3015538|gb|A     GDVQTHIRALYLEPTED-LAPAQEVGHAPSQE--DERSALDVASEQRRLWPTLSPEKQQE      512
gi|6572379|emb|     ACCSDRIQPFDDEEDED----------IWEDS--DTRCAARVMARPRFGAPHASESCSK-     265
gi|17485528|ref     GDVQTHIRALYLEPTED-LAPAQEVGHAPSQE--DERSALDVASEQRRLWPTLSPEKQQE      769
gi|12698077|dbj     NAVQEQVRSLYLSAKEDNHAPHLKQKDKLPDDHYQEKTAYDIAAEQLRLWPTLSKSTQQE     705
gi|15292603|gb|     QDVQGOIKALYLHRRQ-NEHQEANCVLDEVPLEEPTALKITAEQLKKSPNIEEEKKAE       522

790       800       810       820       830       840
                    ....|....|....|....|....|....|....|....|....|....|....|....|
NOV3a               LVQKEESTVFSQAIHRANRMSYLLEPLDSSKSRLLREPAGLGDLESASNSIVTNSMAGSV      572
NOV3b               LVQKEESTVFSQAIHRANRMSYLLEPLDSSKSRLLREPAGLGDLESASNSIVTNSMAGSV      618
gi|3015538|gb|A     LVQKEESTVFSQAIHRANRMSYLLEPLDSSKSRLLREPAGLGDLESASNSIVTNSMAGSV      572
gi|6572379|emb|     -NGPERGG---------QEGKRSLEAHRDAPGAGAPPAPG----KKEAP-PVEGESEAGAN    311
gi|17485528|ref     LVQKEESTVFSQAIHRANRMSYLLEPLDSSKSRLLREPAGLGDLESASNSIVTNSMAGSV      829
gi|12698077|dbj     LVQEESTVFSQAIHRANLMVNLLEPLDSKNRLLRTSA-PGDWESGSNSIVTNSMAGSV        764
gi|15292603|gb|     LAKSEESTISYSQAIHRANRMVSLLEPLDVNVDAASKPKP---AFRLEBNQSVSNSIMGSH    579

850       860       870       880       890       900
                    ....|....|....|....|....|....|....|....|....|....|....|....|
NOV3a               AESYDTESGFEDAERCDVAGAVVRFINRFVDKVCTESGVTSDHHKGLHVMVPDIVQMHIE      632
NOV3b               AESYDTESGFEDAERCDVAGAVVRFINRFVDKVCTESGVTSDHHKGLHVMVPDIVQMHIE      678
gi|3015538|gb|A     AESYDTESGFEDAERCDVAGAVVRFINRFVDKVCTESGVTSDHHKGLHVMVPDIVQMHIE      632
gi|6572379|emb|     WTAVFDEP----ANETPTAPGVVRDYG----SSVWANCTSAPEEKGWAKFT------DFQ     357
gi|17485528|ref     AESYDTESGFEDAERCDVAGAVVRFINRFVDKVCTESGVTSDHHKGLHVMVPDIVQMHIE      889
gi|12698077|dbj     AESYDTESGFEDSENTDRNNVVVRFITRFEDCVCTESGVTQDHRKSLHCMEPGIVAMHIE      824
gi|15292603|gb|     SLSEFEDEGFEMNNALEIGVTVGKTISRFEDCVCTEGGVTSEHRKNLHDMVPGKVHMHIE    639

910       920       930       940       950       960
                    ....|....|....|....|....|....|....|....|....|....|....|....|
NOV3a               TLEAVRRESRRLPPIQKPKSLRPRLLPGEECVLDGLRVYLPPDGREEGAGGSAGGPALLP      692
NOV3b               TLEAVRRESRRLPPIQKPKSLRPRLLPGEECVLDGLRVYLPPDGREEGAGGSAGGPALLP      738
gi|3015538|gb|A     TLEAVRRESRRLPPIQKPKSLRPRLLPGEECVLDGLRVYLPPDGREEGAGGSAGGPALLP      692
gi|6572379|emb|     PFCCDESGPRCSSEVDT-----------ECS-HAE------GSRSCGP-----------      387
gi|17485528|ref     TLEAVRRESRRLPPIQKPKSLRPRLLPGEECVLDGLRVYLPPDGREEGAGGSAGGPALLP      949
gi|12698077|dbj     TLEAVHRESRRLPPIQKPKKLRPALLPGEEIVCEGLRVLLPDGREEATGGLLGGPQLLP     884
gi|15292603|gb|     SLEPVYLEAKRHPHYQKPKHQTPCLLPGELLVTDHLRCELNPDGREDET------QCLRP    693
```

TABLE 3F-continued

ClustalW Analysis of NOV3

```
                    970       980       990      1000      1010      1020
                ....|....|....|....|....|....|....|....|....|....|....|....|
NOV3a           AEGAVFLTTYRVIFRGMPTDPLVGEQVVRSFPVAALTKEKRISVQ--TPVDQLLQDGLQ    750
NOV3b           AEGAVFLTTYRVIFRGMPTDPLVGEQVVRSFPVAALTKEKRISVQ--TPVDQLLQDGLQ    796
gi|3015538|gb|A AEGAVFLTTYRVIFRGMPTDPLVGEQVVRSFPVAALTKEKRISVQ--TPVDQLLQDGLQ    750
gi|6572379|emb| ----------EKAFS--PASECAWNVCVTRKAPLLAS--RSS--SS----GGSHSEDGDQ    427
gi|17485528|ref AEGAVFLTTYRVIFRGMPTDPLVDEQVVRSFPVAALTKEKRISVQ--TPVDQLLQDGLQ   1007
gi|12698077|dbj AEGAFFLTTYRVIFKFRGTPHDQLVGEQIVVRSFPRANSTKEKRIRMQ--NQLQQNKQDGLQ  942
gi|15292603|gb| AEGAVFLTNYRVIFKGSPCDPLFCEQVFVRSFPRASLLKEKISVLYLAHEDQILLTEGLQ   753

1030      1040      1050      1060      1070      1080
                ....|....|....|....|....|....|....|....|....|....|....|....|
NOV3a           LRSCRFQLRKVAFDEEVGSESAELFRKQLHKLRYPPDIRATFAFTLGSAHTPGRPPRVTK    810
NOV3b           LRSCRFQLRKVAFDEEVGSESAELFRKQLHKLRYPPDIRATFAFTLGSAHTPGRPPRVTK    856
gi|3015538|gb|A LRSCRFQLRKVAFDEEVGSESAELFRKQLHKLRYPPDIRATFAFTLGSAHTPGRPPRVTK    810
gi|6572379|emb| KAASAMDAVSRGPGREAPP---------LPTVARTEIAVGRVGCADSRLLSPACEAPKEV    478
gi|17485528|ref LRSCRFQLRKVAFDEEVGSESAELFRKQLHKLRYPPDIRATFAFTLGSAHTPGRPPRVTK   1067
gi|12698077|dbj ITSASFQLRKVAFDEEVSPEVVELFRKQLMKFRYPQSIFSTFAFAAG-QTTPQIILPKQK   1001
gi|15292603|gb| LRSSSFQLRKVAPDPEVTPKQIESFRKILSKARHPFDEFEYFAFQSYGTMLQGVAPLKTK    813

1090      1100      1110      1120      1130      1140
                ....|....|....|....|....|....|....|....|....|....|....|....|
NOV3a           RKGPSLRTLSR-NLVKNAKKR----IGRQVVTRKKYNPPSMEHRGQPPRRDQEDERSVSR    865
NOV3b           RKGPSLRTLSR-NLVKNAKKR----IGRQVVTRKKYNPPSMEHRGQPPRRDQEDERSVSR    911
gi|3015538|gb|A RKGPSLRTLSR-NKVKNAKKR----IGRQVVTRKKYNPPSMEHRGQPPRRDQEDERSVSR    865
gi|6572379|emb| TAAEAVAVPPEATVAITTALS--------------------KAGPAI TPAVSSALAVAV    518
gi|17485528|ref RKGPSLRTLSR-NLVKNAKKR----IGRQVVTRKKYNPPSMEHRGQPPRRDQEDERSVSR   1122
gi|12698077|dbj IKNISFRTFSR-TEVKGAKRAGKMTIGROVLRKKTG-TIVEERVNRPGWNEDDRSVSR   1059
gi|15292603|gb| EKYSRLRGFAKKTLERGAKKAG--FKQRQQTKRELVSDYDVGSADAQETQSIRDERTEDGR  871

1150      1160      1170      1180      1190      1200
                ....|....|....|....|....|....|....|....|....|....|....|....|
NOV3a           ELEPSTLTPSSALKPSDRMTSSLVERACCRDYQRLGLGTRSSSLSRAKSEPFRISPVNR    925
NOV3b           ELEPSTLTPSSALKPSDRMTSSLVERACCRDYQRLGLGTRSSSLSRAKSEPFRISPVNR    971
gi|3015538|gb|A ELEPSTLTPSSALKPSDRMTSSLVERACCRDYQRLGLGTRSSSLSRAKSEPFRISPVNR    925
gi|6572379|emb| PLGE---IMAVTAAEAMVAILGTVTKDGQMPRQKELP-----------------------  552
gi|17485528|ref ELEPSTLTPSSALKPSDRMTSSLVERACCRDYQRLGLGTRSSSLSRAKSEPFRISPVNR   1182
gi|12698077|dbj ESE---LPTSTILKASEKSTMEQLVEKACRDYQRLGTRSGSSRSEPEYFRISASNR    1116
gi|15292603|gb| EFET--QNKAMPRLLTTKDMERMRERSYVQDWKRLGFDAES-------QRGFRISNANT    921

1210      1220      1230      1240      1250      1260
                ....|....|....|....|....|....|....|....|....|....|....|....|
NOV3a           MYARCRSYPGLLIVPQSVQDNALQRNSRCYRQNRFPVVCWRSERSKAVLRSGGLRGKGV    985
NOV3b           MYARCRSYPGLLIVPQSVQDNALQRNSRCYRQNRFPVVCWRSERSKAVLRSGGLRGKGV   1031
gi|3015538|gb|A MYARCRSYPGLLIVPQSVQDNALQRNSRCYRQNRFPVVCWRSERSKAVLRSGGLRGKGV    985
gi|6572379|emb| ------------------------------------------------------------  552
gi|17485528|ref MYARCRSYPGLLIVPQSVQDNALQRNSRCYRQNRFPVVCWRSGRSKAVLRSGGLRGKGV   1242
gi|12698077|dbj MYSRCRR-----------------------------------------------------  1123
gi|15292603|gb| SYATCRSYPAILIAPVQCSDAAKMHKGRCKRGQRIPSPTWRHANG-ALIRRGGQPKSKSV    980

1270      1280      1290      1300      1310      1320
                ....|....|....|....|....|....|....|....|....|....|....|....|
NOV3a           VGLFKAQNAPSPGQSQADRSSLEQRKYLQAVVSMPRYADASG-RNILSGFSSAHMGSEV   1044
NOV3b           VGLFKAQNAPSPGQSQADRSSLEQRKYLQAVVSMPRYADASG-RNILSGFSSAHMGSEG   1090
gi|3015538|gb|A VGLFKAQNAPSPGQSQADRSSLEQRKYLQAVVSMPRYADASG-RNILSGFSSAHMGSEV   1044
gi|6572379|emb| ------------------------------------------------------------  552
gi|17485528|ref VGLFKAQNAPSPGQSQADRSSLEQRKYLQAVVSMPRYADASG-RNILSGFSSAHMGSHV   1301
gi|12698077|dbj ------------------------------------------------------------ 1123
gi|15292603|gb| IGMLKNTTGSTTNAHHDVIHYPEQRKYFLARLNSMPKLTPLSLNQYSGMNLSMSSIMGHS   1040

1330      1340      1350      1360      1370      1380
                ....|....|....|....|....|....|....|....|....|....|....|....|
NOV3a           PSPRARVTTLSNPMAASASRRTAPRGKWGSVRTSGRSSGLGTDVGSRLAGRDALAPPQAN   1104
NOV3b           -------------------------KWGSVRTSGRSSGLGTDVGSRLAGRDALAPPQAN   1124
gi|3015538|gb|A -------------------------KWGSVRTSGRSSGLGTDVGSRLAGRDALAPPQAN   1078
gi|6572379|emb| ------------------------------------------------------------  552
gi|17485528|ref P-----------------------SPRARVTTLSNPMAASASRRTAPRG--------   1327
gi|12698077|dbj ------------------------------------------------------------ 1123
gi|15292603|gb| SSD-------------------DRQPLTPELSRKHKNNLDISDGNKSSQGGKGGTMK   1078

1390      1400      1410      1420      1430      1440
                ....|....|....|....|....|....|....|....|....|....|....|....|
NOV3a           GGPPDPGFLRPQRAALYILGDKAQLKGVRSDPLQQWELVPIEVFEARQVKASFKKLLKAC  1164
NOV3b           GGPPDPGFLRPQRAALYILGDKAQLKGVRSDPLQQWELVPIEVFEARQVKASFKKLLKAC  1184
gi|3015538|gb|A GGPPDPGFLRPQRAALYILGDKAQLKGVRSDPLQQWELVPIEVFEARQVKASFKKLLKAC  1138
gi|6572379|emb| ------------------------------------------------------------  552
gi|17485528|ref ------------------------------------------------------------ 1327
gi|12698077|dbj ------------------------------------------------------------ 1123
gi|15292603|gb| GNPKNSLAHPFRKMRLYALGEKSQAKSN-MNVDFCADFIPVDYPDIRQSRPAFKKLIRAC  1137
```

TABLE 3F-continued

ClustalW Analysis of NOV3

```
                   1450       1460       1470       1480       1490       1500
               ....|....|....|....|....|....|....|....|....|....|....|....|
NOV3a          VPGCPAAEPSPASFLRSLEDSEWLIQIHKLLQVSVLVVELLDSG-SSVLVGLEDGWDITT      1223
NOV3b          VPGCPAAEPSPASFLRSLEDSEWLIQIHKLLQVSVLVVELLDSG-SSVLVGLEDGWDITT      1243
gi|3015538|gb|A VPGCPAAEPSPASFLRSLEDSEWLIQIHKLLQVSVLVVELLDSG-SSVLVGLEDGWDITT     1197
gi|6572379|emb| ------------------------------------------------------------      552
gi|17485528|ref ------------------------------------------------------------     1327
gi|12698077|dbj ------------------------------------------------------------     1123
gi|15292603|gb| MPSHNTNEADGQSFAKMVEQSDWLQQISSLMQLSGAVVDLIDLQESSVMLSLEDGSDVTA     1197

1510       1520       1530       1540       1550       1560
               ....|....|....|....|....|....|....|....|....|....|....|....|
NOV3a          QVVSLVQLLSDPFYRTLEGFRLLVEKEWLSFGHRFSHRG--AHTLAGQSSGFTPVFLQFL      1281
NOV3b          QVVSLVQLLSDPFYRTLEGFRLLVEKEWLSFGHRFSHRG--AHTLAGQSSGFTPVFLQFL      1301
gi|3015538|gb|A QVVSLVQLLSDPFYRTLEGFRLLVEKEWLSFGHRFSHRG--AHTLAGQSSGFTPVFLQFL     1255
gi|6572379|emb| ------------------------------------------------------------      552
gi|17485528|ref ------------------------------------------------------------     1327
gi|12698077|dbj ------------------------------------------------------------     1123
gi|15292603|gb| QLSSIAQLCLDPYYRSLDGFRVLVEKEWLAFGHRFAHRSNLKPSHANTNIAFAPTFLQFL     1257

1570       1580       1590       1600       1610       1620
               ....|....|....|....|....|....|....|....|....|....|....|....|
NOV3a          DCVHQVHLQFPMEFEFSQFYLKFLGYHHVSRRFRTFLLDSDYERIELGLLYEEK------      1335
NOV3b          DCVHQVHLQFPMEFEFSQFYLKFLGYHHVSRRFRTFLLDSDYERIELGLLYEEK------      1355
gi|3015538|gb|A DCVHQVHLQFPMEFEFSQFYLKFLGYHHVSRRFRTFLLDSDYERIELGLLYEEK------     1309
gi|6572379|emb| ------------------------------------------------------------      552
gi|17485528|ref ------------------------------------------------------------     1327
gi|12698077|dbj ------------------------------------------------------------     1123
gi|15292603|gb| DVVHQLQRQFPMAFEFNDFYLRFLAYHSVSCRFRTFLFDCELERSDSGIAAMEDKRGSLN     1317

1630       1640       1650       1660       1670       1680
               ....|....|....|....|....|....|....|....|....|....|....|....|
NOV3a          -------------------------GERRGQVPCR----SVWEYVDRLDKRTPVFHNYM      1365
NOV3b          -------------------------GERRGQVPCR----SVWEYVDRLSKRTPVFHNYM      1385
gi|3015538|gb|A -------------------------GERRGQVPCR----SVWEYVDRLSKRTPVFHNYM     1339
gi|6572379|emb| ------------------------------------------------------------      552
gi|17485528|ref ------------------------------------------------------------     1327
gi|12698077|dbj ------------------------------------------------------------     1123
gi|15292603|gb| AKHMFGAGGMATNGSDDECSVYPLDIRSQRAPAPLNRIGHSIFDYIERQHNKTPIFYNFL     1377

1690       1700       1710       1720       1730       1740
               ....|....|....|....|....|....|....|....|....|....|....|....|
NOV3a          YAPEDAEVLRPYSNVSNLKVWDFYTEETLAEALPMTGNWPRGPLNPQRKNGLMEASPE-Q     1424
NOV3b          YAPEDAEVLRPYSNVSNLKVWDFYTEETLAEGPPYDWELAQGPPEPPEEERSDGGAPQSR     1445
gi|3015538|gb|A YAPEDAEVLRPYSNVSNLKVWDFYTEETLAEALPMTGNWPRGPLNPQRKNGLMEASPE-Q    1398
gi|6572379|emb| ------------------------------------------------------------      552
gi|17485528|ref ------------------------------------------------------------     1327
gi|12698077|dbj ------------------------------------------------------------     1123
gi|15292603|gb| YSGDKSVTLRPQNNVAALDLWCYYTNEELAQGAPYDLEVT------TVDDEIDLSETKGK     1431

1750       1760       1770       1780       1790       1800
               ....|....|....|....|....|....|....|....|....|....|....|....|
NOV3a          RRVVWPCYDSCPRAQPDAISRLLEELQRLETELGQPAERWKDTWDRVKAAQRLEGRPDGR     1484
NOV3b          RRVVWPCYDSVPRAQPDAISRLLEELQRLETELGQPAERWKDTWDRVKAAQRLEGRPDGR     1505
gi|3015538|gb|A RRVVWPCYDSVPRAQPDAISRLLEELQRLETELGQPAERWKDTWDRVKAAQRLEGRPDGR    1458
gi|6572379|emb| ------------------------------------------------------------      552
gi|17485528|ref ------------------------------------------------------------     1327
gi|12698077|dbj ------------------------------------------------------------     1123
gi|15292603|gb| RMVITAGYDNMEKCNPSAYVCLLSEVKQAETERGHLPQKWLQVWNSLEVPQLEPVARN--     1489

1810       1820       1830       1840       1850       1860
               ....|....|....|....|....|....|....|....|....|....|....|....|
NOV3a          GTPSSLLVSTAPHHRRSLGVYLQEGPVG--------------------------------     1512
NOV3b          GTPSSLLVSTAPHHRRSLGVYLQEGPVG--------------------------------     1533
gi|3015538|gb|A GTPSSLLVSTAPHHRRSLGVYLQEGPVG--------------------------------    1486
gi|6572379|emb| ------------------------------------------------------------      552
gi|17485528|ref ------------------------------------------------------------     1327
gi|12698077|dbj ------------------------------------------------------------     1123
gi|15292603|gb| TSLGNIFVQTHQHKRSTLEIIMKGRLAGYQDKYFHPHRFEKHPYTTPTNCNHCTKLLWGP     1549

1870       1880       1890       1900       1910       1920
               ....|....|....|....|....|....|....|....|....|....|....|....|
NOV3a          ----------------------STLSLSLD----------SDQSSGSTTSGSRQAARRS     1539
NOV3b          ----------------------STLSLSLD----------SDQSSGSTTSGSRQAARRS     1560
gi|3015538|gb|A ----------------------STLSLSLD----------SDQSSGSTTSGSRQAARRS    1513
gi|6572379|emb| ------------------------------------------------------------      552
gi|17485528|ref ------------------------------------------------------------     1327
gi|12698077|dbj ------------------------------------------------------------     1123
gi|15292603|gb| VGYRCMDCGNSYHEKCTEHSMKNCTKYKAIDGAVGPPNVNMSQGDTASIASSAATTARTS     1609
```

TABLE 3F-continued

ClustalW Analysis of NOV3

```
                        1930      1940      1950      1960      1970      1980
                   ....|....|....|....|....|....|....|....|....|....|....|....|
NOV3a              TSTLYSQFQTAESENRSYEGTLYKKGAFMKPWKARWFVLDKTKHQLRYYDHTVDTECKGV    1599
NOV3b              TSTLYSQFQTAESENRSYEGTLYKKGAFMKPWKARWFVLDKTKHQLRYYDHTVDTECKGV    1620
gi|3015538|gb|A    TSTLYSQFQTAESENRSYEGTLYKKGAFMKPWKARWFVLDKTKHQLRYYDHTVDTECKGV    1573
gi|6572379|emb|    ------------------------------------------------------------     552
gi|17485528|ref    ------------------------------------------------------------    1327
gi|12698077|dbj    ------------------------------------------------------------    1123
gi|15292603|gb|    SHHFYNQFSSNVAENRTHEGHLYKRGALLKGWKQRWFVLDSIKHQLRYYDTSEDTAPKGI    1669

1990      2000      2010      2020      2030      2040
                   ....|....|....|....|....|....|....|....|....|....|....|....|
NOV3a              IDLAEVEAVAPGTPTMGAPKTVDEKAFFDVKTTRRVYNFCAQDVPSAQQWVDRIQSCCRT    1659
NOV3b              IDLAEVEAVAPGTPTMGAPKTVDEKAFFDVKTTRRVYNFCAQDVPSAQQEVDRIQSCLSD    1680
gi|3015538|gb|A    IDLAEVEAVAPGTPTMGAPKTVDEKAFFDVKTTRRVYNFCAQDVPSAQQWVDRIQSCCRT    1633
gi|6572379|emb|    ------------------------------------------------------------     552
gi|17485528|ref    ------------------------------------------------------------    1327
gi|12698077|dbj    ------------------------------------------------------------    1123
gi|15292603|gb|    IELAEVQSVTAAQPAQIGAKGVDEKGFFDLKTSKRIYNFYAINANLAQEWIEKLQACLQ-    1728

2050      2060      2070      2080      2090      2100
                   ....|....|....|....|....|....|....|....|....|....|....|....|
NOV3a              PEPPSPARLLCSRYRPLGVAGPPRPCLQPRPSTVLSPEPPALVCTAPVPAPPRPAGPNLF    1719
NOV3b              A-----------------------------------------------------------    1681
gi|3015538|gb|A    PEPPSPARLLCSRYRPLGVAGPPRPCLQPRPSTVLSPEPPALVCTAPVPAPPRPAGPNLF    1693
gi|6572379|emb|    ------------------------------------------------------------     552
gi|17485528|ref    ------------------------------------------------------------    1327
gi|12698077|dbj    ------------------------------------------------------------    1123
gi|15292603|gb|    ------------------------------------------------------------    1728

....
NOV3a              WRHS                                                            1723
NOV3b              ----                                                            1681
gi|3015538|gb|A    WRHS                                                            1697
gi|6572379|emb|    ----                                                             552
gi|17485528|ref    ----                                                            1327
gi|12698077|dbj    ----                                                            1123
gi|15292603|gb|    ----                                                            1728
```

Tables 3G–3I list the domain descriptions from DOMAIN analysis results against NOV3a. This indicates that the NOV3a sequence has properties similar to those of other proteins known to contain this domain.

TABLE 3G

Domain Analysis of NOV3a gnl|Pfam|pfam02141, DENN, DENN (AEX-3) domain. (SEQ ID NO:73)
CD-Length = 146 residues, 51.4% aligned
Score = 69.3 bits (168), Expect = 2e-12

```
Query:     5 VFLSRSYQRLADACRGLLALLFPLRYSFTYVPILPAQLLEVLSTPTPFIIGVNAAFQAET   64
             +|  ||     |+  |   ++|||+|   +     |+|+|||   |  +||   ||++|   ++|
Sbjct:    70 LFHSRKLSTLSSCCEAVVALLYPFEWQCPYIPLLPASLADVLLAPTPYLIGVPSSFFDNK  129

Query:    65 QELL---DVIVADLD                                                76
             |     ||| |||
Sbjct:   130 LLELPPSDVICVDLD                                               144
```

TABLE 3H

Domain Analysis of NOV3a gnl|Smart|smart00233, PH, Pleckstrin homology domain.; Domain commonly found in eukaryotic signalling proteins. The domain family possesses multiple functions including the abilities to bind inositol phosphates, and various proteins. PH domains have been found to possess inserted domains (such as in PLC gamma, syntrophins) and to be inserted within other domains. Mutations in Brutons tyrosine kinase (Btk) within its PH domain cause X-linked agammaglobulinaemia (XLA) in patients. Point mutations cluster into the positively charged end of the molecule around the predicted binding site for phosphatidylinositol lipids. (SEQ ID NO:74)
CD-Length = 104 residues, 96.2% aligned

TABLE 3H-continued

Domain Analysis of NOV3a

Score = 63.5 bits (153), Expect = 9e-11

```
Query:  1557  YEGTLYKKGA-FMKPWKARWFVLDKTKHQLRYYDHR---VDTECKGVIDLAEVEAVAPGT  1612
              ||  || +   | || |+|||     | || +    ++ ||  |+
Sbjct:     3  KEGWLLKKSSGGKKSWKKRYFVL--FNGVLLYYKSKKKKSSSKPKGSIPLSGCTVREAPD    60

Query:  1613  PTMGAPKTVDEKAFFDVKT-TRRVYNFCAQDVPSAQQWVDRIQSCCR                  1658
                +  +|  |++ |   |+      |+      ++||+ ++
Sbject:   61  S-----DSDKKKNCFEIVTPDRKTLLLQAESEEERKEWVEALRKAIA                  102
```

TABLE 3I

Domain Analysis of NOV3a gnl|Pfam|pfam00169, PH, PH domain. PH stands for pleckstrin homology.
(SEQ ID NO:75)
CD-Length = 100 residues, 97.0% aligned
Score = 53.1 bits (126), Expect = 1e-07

```
Query:  1558  EGTLYKKGAFMKP-WKARWFVLDKTKHQLRYYDHRV-DTECKGVIDLAEVEAVAPGTPTM  1615
              || | ||     | || |+| |     ||| +   | || | |+
Sbjct:     4  EGWLLKKSTVKKKRWKKRYFFL--FNDVLIYYKDKKKSYEPKGSIPLSGCSVEDVPDSEF    61
Query:  1616  GAPKTVDEKAFFDVKTTRR--VYNFCAQDVPSAQQWVDRIQSCCR                    1658
              |         | +++    + |+     | |+ |||  |
Sbject:   62  KRPNC------FQLRSRDGKETFILQAESEEERQDWIDAIQSAIR                    100
```

Mammalian SET domain-containing proteins define a distinctive class of chromatin-associated factors that are targets for growth control signals and oncogenic activation. By yeast two-hybrid screening, Cui X et al. (1998,Nat. Genet. Vol. 18: 331–337) identified Sbf1 (also known as nuclear dual-specificity phosphatase) as a protein interacting with the SET domain in the protooncoprotein homolog of Drosophila trithorax, Hrx. Sbf1, shares extensive sequence similarity with myotubularin, a dual specificity phosphatase (dsPTPase) that is mutated in a subset of patients with inherited myopathies. Both Sbf1 and myotubularin interact with the SET domains of Hrx and other epigenetic regulatory proteins, but Sbf1 lacks phosphatase activity due to several evolutionarily conserved amino acid changes in its structurally preserved catalytic pocket. Sbf1 has shown to prevent myoblast differentiation in vitro and induce oncogenic changes in NIH 3T3 fibroblasts. Furthermore, it also functions as SET domain-dependent positive regulator of growth-inducing kinase signaling pathways (Immaculata De Vivo et al., 1998, Proc. Natl. Acad. Sci. USA, vol 95: 9471–9476).

The disclosed NOV3 nucleic acid of the invention encoding a Set Binding Factor (SBF1)-like protein includes the nucleic acid whose sequence is provided in Table 3A, 3C, or a fragment thereof. The invention also includes a mutant or variant nucleic acid any of whose bases may be changed from the corresponding base shown in Table 3A, or 3C while still encoding a protein that maintains its Set Binding Factor (SBF1)-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 9 percent of the bases may be so changed.

The disclosed NOV3 protein of the invention includes the Set Binding Factor (SBF 1)-like protein whose sequence is provided in Table 3B, or 3D. The invention also includes a mutant or variant protein any of whose residues may be changed from the corresponding residue shown in Table 3B, or 3D while still encoding a protein that maintains its Set Binding Factor (SBF1)-like activities and physiological functions, or a functional fragment thereof. In the mutant or variant protein, up to about 63 percent of the residues may be so changed.

The protein similarity information, expression pattern, and map location for the Set Binding Factor (SBF1)-like protein and nucleic acid (NOV3) disclosed herein suggest that NOV3 may have important structural and/or physiological functions characteristic of the citron kinase-like family. Therefore, the NOV3 nucleic acids and proteins of the invention are useful in potential diagnostic and therapeutic applications. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/ gene ablation), and (v) a composition promoting tissue regeneration in vitro and in vivo.

The NOV3 nucleic acids and proteins of the invention are useful in potential diagnostic and therapeutic applications implicated in various diseases and disorders described below. For example, the compositions of the present invention will have efficacy for treatment of patients suffering from Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyban syndrome, multiple sclerosis, ataxia-telangiectasia, leukodystrophies, behavioral disorders, addiction, anxiety, pain, neurodegeneration; Cholesteryl ester storage disease; Corneal dystrophy, Thiel-Behnke type; Dubin-Johnson syndrome; leukemia, T-cell acute lymphocytic; Retinol binding protein, deficiency of; SEMD, Pakistani type; Spinocerebellar ataxia, infantile-onset, with sensory neuropathy; Split hand/foot malformation, type 3; Tolbutamide poor metabolizer; Urofacial syndrome; Warfarin sensitivity; Wolman disease, and/or other pathologies.

NOV3 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV3 protein have multiple hydrophilic regions, each of which can be used as an immunogen. This novel protein also has value in development of powerful assay system for functional analysis of various human disorders, which will help in understanding of pathology of the disease and development of new drug targets for various disorders.

NOV4

A disclosed NOV4 nucleic acid of 762 nucleotides (designated CuraGen Acc. No. CG55692-01) encoding a novel TSPAN-1-like protein is shown in Table 4A. An open reading frame was identified beginning with an ATG initiation codon at nucleotides 9–11 and ending with a TAA codon at nucleotides 732–734. A putative untranslated region downstream from the termination codon is underlined in Table 4A, and the start and stop codons are in bold letters.

TABLE 4A

NOV4 Nucleotide Sequence (SEQ ID NO:21)

GACACACCATGCAGTGCTTCAAATTCATTAAGGTCATGATGTTCCTCTTCAATCAACTCATCTTTCTCTG

TGGTGCAGCCCTGTTGGCTGTGGGAATATGGGTAACCGTCGATGGGACATCTTTCCTGAAGGTCTTCGGA

TCACTATCATCCAGTGCCATGCAGTTTGTCAACGTGGGCTACTTCCTCATCGCCGCTGGTGCTGTGCTCT

TCATTTTTGGTTTCCTGGGCTGCTATGGTGCTCCCTCTGAGAAACAAGTGTGTGCTCTGGTGATGTTCTT

TTCCATCCTCCTCATCATCTTCATCGCTGAGATTGCAGGTGCTGTGGTTGCTTTGGTGTACACCACATTG

GCTGAACAATTCCTGACACTCCTGGTGGTGCCTGCTATCGAAAAAGACTATGGTTACCAGACTGATTTCA

CCCAAGTATGGAACACTACAATGGAAGAGTTGCATTGCTGTGGCTTTAACAACTACACAGATTTTAATGC

CTCACGTTTCGTCAAAGAGAATAAAGTCTTCCCCCCACCCTGTTGTGCCAACCCTGGCAACCATACAGTT

GAACCATGCACCGAGGAGAAGGCCAAAAGTATGAAAGTACAGGGTTGTTTCAAAGAGATTCTGCATAGAA

TCAGAAACAATGCAGTCACTGTGGGTGGTGTGGCAGTTGGAGTTGCGGCCCTAGAGCTGGCTGCCATGGT

TGTATCCATGTATCTATACTGCAATCTGAAATAAGACTACTACTTCCTCCTGACTTGCTGCC

The nucleic acid sequence, localized to chromosome 12, has 616 of 765 bases (80%) identical to a gb:GENBANK-ID:AF065388|acc:AF065388.1 mRNA from Homo sapiens (Homo sapiens tetraspan NET-1 mRNA, complete cds) (E=11.8e$^{-100}$).

A NOV4 polypeptide (SEQ ID NO:22) encoded by SEQ ID NO:21 is 241 amino acid residues and is presented using the one letter code in Table 4B. Signal P, Psort and/or Hydropathy results predict that NOV4 has no signal peptide and is likely to be localized at the plasma membrane with a certainty of 0.6400. In other embodiments, NOV4 may also be located to the Golgi body with a certainty of 0.4600, the endoplasmic reticulum (membrane) with a certainty of 0.3700, or the endoplasmic reticulum (lumen) with a certainty of 0.1000.

The most likely cleavage site for NOV4 is between positions 36 and 37: VDG-TS.

TABLE 4B

NOV4 protein sequence (SEQ ID NO:22)

MQCFKFIKVMMFLFNQLIFLCGAALLAVGIWVTVDGTSFLKVFGSLSSSAMQFVNVGYFLIAAGAVLFIFGFLG

CYGAPSEKQVCALVMFFSILLIIFIAEIAGAVVALVYTTLAEQFLTLLVVPAIEKDYGYQTDFTQVWNTTMEEL

HCCGFNNYTDFNASRFVKENKVFPPPCCANPGNHTVEPCTEEKAKSMKVQGCFKEILHRIRNNAVTVGGVAVGV

AALELAAMVVSMYLYCNLK

The full amino acid sequence of the protein of the invention was found to have 177 of 241 amino acid residues (73%) identical to, and 197 of 241 amino acid residues (81%) similar to, the 241 amino acid residue ptnr:SPTREMBL-ACC:060635 protein from Homo sapiens (Human) (TSPAN-1) (E=6.1e$^{-92}$).

NOV4 is expressed in at least Colon, Testis, prostate, melanocyte, heart, uterus, kidney, stomach because of the expression pattern of (GENBANK-ID:AF065388|acc:AF065388.1) a closely related 1Homo sapiens tetraspan NET-I mRNA, complete cds homolog in species Homo sapiens:

NOV4 also has homology to the amino acid sequences shown in the BLASTP data listed in Table 4C.

TABLE 4C

BLAST results for NOV4

| Gene Index/ Identifier | Protein/Organism | Length (aa) | Identity (%) | Positives (%) | Expect |
|---|---|---|---|---|---|
| gi\|13097420\|gb\|AAH03448.1\| AAH03448 (BC003448) | Similar to tetraspan 1 [Mus musculus] | 240 | 210/241 (87%) | 213/241 (88%) | e-104 |
| gi\|5032197\|ref\|NP_005718.1\| (NM_005727) | tetraspan 1 [Homo sapiens] | 241 | 161/242 (66%) | 179/242 (73%) | 3e-67 |
| gi\|12643622\|sp\|O60635\| TSN1_HUMAN | TETRASPANIN 1 (TSPAN-1) (TETRASPAN NET-1) (TETRASPANIN TM4-C) | 241 | 160/242 (66%) | 179/242 (73%) | 7e-67 |
| gi\|6601561\|gb\|AAF19031.1\| AF206661_1 (AF206661) | neuronal tetraspanin [Gallus gallus] | 247 | 76/217 (35%) | 111/217 (51%) | 2e-17 |
| gi\|17570135\|ref\|NP_510445.1\| (NM_078044) | tetraspanin [Caenorhabditis elegans] | 282 | 52/165 (31%) | 83/165 (49%) | 1e-16 |

The homology of these sequences is shown graphically in the ClustalW analysis shown in Table 4D.

TABLE 4D

ClustalW Analysis of NOV4

1) NOV4 (SEQ ID NO:22)
4) gi|13097420|gb|AAH03448.1|AAH03448 (BC003448) Similar to tetraspan 1
[Mus musculus] (SEQ ID NO:76)
5) gi|5032197|ref|NP_005718.1| (NM_005727) tetraspan 1 (Homo sapiens) (SEQ ID NO:77)
6) gi|12643622|sp|O60635|TSN1_HUMAN TETRASPANIN 1 (TSPAN-1) (TETRASPAN NET-1)
(TETRASPANIN TM4-C) (SEQ ID NO:78)
7) gi|6601561|gb|AAF19031.1|AF206661_1 (AF206661) neuronal tetraspanin [Gallus gallus]
(SEQ ID NO:79)
8) gi|17570135|ref|NP_510445.1|(NM_078044) tetraspanin [Caenorhabditis elegans]
(SEQ ID NO:80)

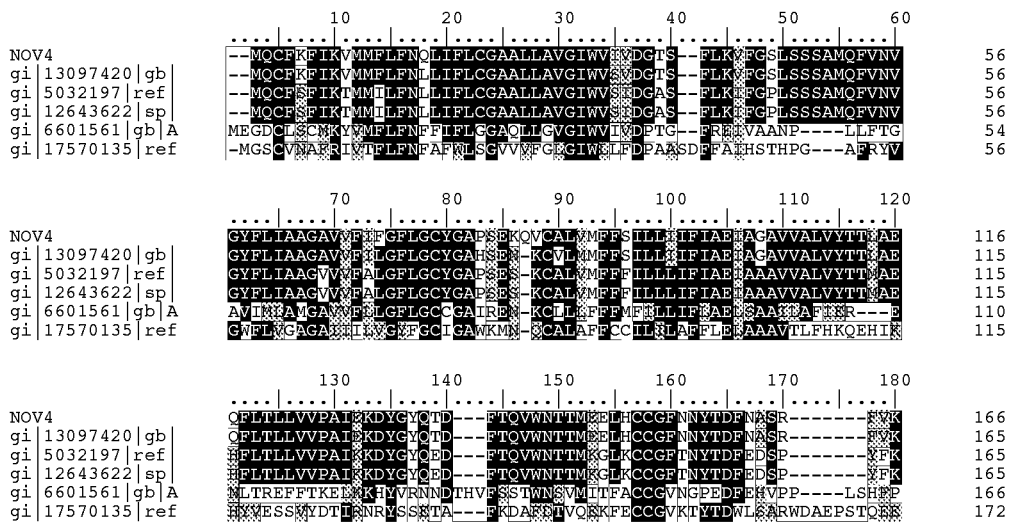

TABLE 4D-continued

ClustalW Analysis of NOV4

```
                         190       200       210       220       230       240
                    ....|....|....|....|....|....|....|....|....|....|....|....|
NOV4                ENK----------------------VFPPPCC-ANPGN--------HTVEPCTEEKAKSM   195
gi|13097420|gb|     ENK----------------------VFPPPCC-ANPGN--------HTVEPCTEEKAKSM   194
gi|5032197|ref      ENS----------------------AFPPFCCNDNVTN--------TANETCTEEKAHDQ   195
gi|12643622|sp      ENS----------------------AFPPFCCNDNVTN--------TANETCTKQKAHDQ   195
gi|6601561|gb|A     LEK----------------------TTPEACCQRNVQSREGM---FVNRKACLEGDERFQ   201
gi|17570135|ref     VNEEDAGRIEHGIGAFGGNKGTGYGRVESSCCNEEGKLSYPNNCGRSFSQAPLNTYAQFI   232

250       260       270       280       290
                    ....|....|....|....|....|....|....|....|....|....|
NOV4                KVQGCFKEELHRIRNNAVTVGGVAEGVAALELAAMKVSMYLYCNLK----              241
gi|13097420|gb|     KVQGCFKEELRRIRANAVTVGGVAEGVAALELAAMEVSMYLYCNLK----              240
gi|5032197|ref      KVEGCFNQLLVDIRINAVTVGGVAAGEGGLELAAMEVSMYLYCNLE----              241
gi|12643622|sp      KVEGCFNQLLVDIRINAVTVGGVAAGEGGLELAAMEVSMYLYCNLE----              241
gi|6601561|gb|A     NRQGCKTVKLNSFEEYVYLAGAEAEGVLAHELFAMEFAMCLERGLQ----              247
gi|17570135|ref     NTEGCADAEYESMSEELSLKVGVCEVQCIVQLLGEVESMILCCKGNSKK               282
```

Table 4E lists the domain description from DOMAIN analysis results against NOV4. This indicates that the NOV4 sequence has properties similar to those of other proteins known to contain this domain.

TABLE 4E

Domain Analysis of NOV4 gnl|Pfam|pfam00335, transmembrane4, Tetraspanin family. (SEQ ID NO:81)
CD-Length = 222 residues, 100.0% aligned
Score = 126 bits (316), Expect = 2e-30

```
Query:    8  KVMMFLFNQLIFLCGAALLAVGIWVTVDGTSFLKVFGSLSSSAMQFVNVGYFLIAAGAVL   67
             | ++||  |  +|||   ||||||||+ ||  +||   ++ |||||        |  ||| || +|
Sbjct:    1  KYLLFLLNLLFWLCGILLLAVGIWLLVDLSSFSELLGSLSSLV-----AAYVLIAVGAIL   55

Query:   68  FIFGFLGCYGAPSEKQVCALVMFFSILLIIFIAEIAGAVVALVYTTLAEQFLTLLVVPAI  127
             |+  |||||  ||   |  +  | |  ++|  ||+|||   |+|    ++|  |+       |   +  ||
Sbjct:   56  FLVGFLGCCGAIRESR-CLLGLYFVFLLLIFILEVAAGILAFVFRDKLESSLNESLKNAI  114

Query:  128  EKDYGYQTDFTQVWNTTMEELHCCGFNNYTDFNASRFVKENKVFPPPCCANPGNHTVEPC  187
              + |   |  |+  |+ |||  | |||+ |++   +  |  ||   +
Sbjct:  115  KNYYDTDPDERNAWDKLQEQFKCCGVNGYTDWFDSQW--FSNGVPFSCCNPSVS---CNS  169

Query:  188  TEEKAKSMKVQGCFKEILHRIRNNAVTVGGVAVGVAALELAAMVVSMYLYCNL         240
             +++  ++  +||   +++|    +  | +  ||||||+|+|  ++|   |++|    |  |++
Sbjct:  170  AQDEEDTIYQEGCLEKLLEWLEENLLIVGGVALGIALIQLLGMILSCCLCCSI         222
```

Members of the 'transmembrane 4 superfamily' (TM4SF) are cell-surface proteins presumed to have 4 transmembrane domains. TM4SF proteins form complexes with integrins and other cell-surface proteins. A number of eukaryotic cell surface antigens have been shown to be related, including mammalian leukocyte antigen CD37, mammalian lysosomal membrane protein CD63, human tumour-associated antigen CD-029, and several others. These proteins are all type II membrane proteins: they contain an N-terminal transmembrane (TM) domain, which acts both as a signal sequence and a membrane anchor, and 3 additional TM regions (hence the name 'TM4'). The sequences contain a number of conserved cysteine residues.

The disclosed NOV4 nucleic acid of the invention encoding a TSPAN-1-like protein includes the nucleic acid whose sequence is provided in Table 4A or a fragment thereof. The invention also includes a mutant or variant nucleic acid any of whose bases may be changed from the corresponding base shown in Table 4A while still encoding a protein that maintains its TSPAN-1-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 20 percent of the bases may be so changed.

The disclosed NOV4 protein of the invention includes the TSPAN-1-like protein whose sequence is provided in Table 4B. The invention also includes a mutant or variant protein any of whose residues may be changed from the corresponding residue shown in Table 4B while still encoding a protein that maintains its TSPAN-1-like activities and physiological functions, or a functional fragment thereof. In the mutant or variant protein, up to about 69 percent of the residues may be so changed.

The protein similarity information, expression pattern, and map location for the TSPAN-1-like protein and nucleic acid (NOV4) disclosed herein suggest that this NOV4 protein may have important structural and/or physiological functions characteristic of the TSPAN-1 family. Therefore, the NOV4 nucleic acids and proteins of the invention are useful in potential diagnostic and therapeutic applications. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo.

The NOV4 nucleic acids and proteins of the invention are useful in potential diagnostic and therapeutic applications implicated in various diseases and disorders described below. For example, the compositions of the present invention will have efficacy for treatment of patients suffering from Hyperealceimia, Ulcers, Inflammatory bowel disease, Diverticular disease, Hirschsprung's disease, Crohn's Disease, Appendicitis, Fertility, Diabetes, Autoimmune disease, Renal artery stenosis, Interstitial nephritis, Glomerulonephritis, Polycystic kidney disease, Systemic lupus erythematosus, Renal tubular acidosis, IgA nephropathy, Hypercalceimia, Lesch-Nyhan syndrome, Cardiomyopathy, Atherosclerosis, Hypertension, Congenital heart defects, Aortic stenosis, Atrial septal defect (ASD), Atrioventricular (A-V) canal defect, Ductus arteriosus, Pulmonary stenosis, Subaortic stenosis, Ventricular septal defect (VSD), valve diseases, Tuberous sclerosis, Scleroderma, Obesity, Transplantation, and/or other pathologies. The NOV4 nucleic acids, or fragments thereof, may further be useful in diagnostic applications, wherein the presence or amount of the nucleic acid or the protein are to be assessed.

NOV4 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. These novel proteins can be used in assay systems for functional analysis of various human disorders, which will help in understanding of pathology of the disease and development of new drug targets for various disorders.

NOV5

A disclosed NOV5 nucleic acid of 469 nucleotides (also referred to as CG56073-01) encoding a novel Fatty Acid-Binding Protein, Epidermal-like protein is shown in Table 5A. An open reading frame was identified beginning with an ATG initiation codon at nucleotides 148–150 and ending with a TGA codon at nucleotides 395–397. Putative untranslated regions upstream from the initiation codon and downstream from the termination codon are underlined in Table 5A, and the start and stop codons are in bold letters.

TABLE 5A

| NOV5 Nucleotide Sequence (SEQ ID NO:23) |
| --- |
| GCCATCTGCCAACCATGGTCACCACTCAGCAGCTGCTAGGAAGATGGCGCCCAGCAGAGAGG |
| AAATACCTCAAAGAAACAGGGATGAGAATGGCCCTGCAAAAAATTGGTGCAATGACTAAACC |
| AGATGGTGCCATCTCTGATGGCAAAAGCTTCACTATAAAAACCAAGAGCACTCTGAAAACAA |
| CACGGTTTTCTTCTAAACTTGGAGAGAAGTATGAAAGAACTACAGGTGATGGCAGAAAAAAC |
| TCACTATTTGTCTGCAACTTTACAAAGCGTGCATTGGTTCAACACTGGGAATGGGATGAGGA |
| AAGAAAAACGAGAAGAAGAAAAGTGGGAGACAAAAAAGCAGGGATGGAATGCATTATGAACA |
| ATGTCACCTGTACTCAGATCTGTGAAAATAAAAAAAGCAGAATAAAAATTTCCTTACTGCTT |
| TGGAGAGCAATTAGCTGAGAGAAGGAACAATTTCA |

The NOV5 nucleic acid was identified on chromosome 2 and has 313 of 411 bases (76%) identical to a gb:GENBANK-ID:AF059507|acc:AF059507.1 mRNA from *Bos taurus* (*Bos taurus* epidermal fatty acid-binding protein (E-FABP) mRNA, complete cds) (E=$4.5e^{-41}$)

A disclosed NOV5 polypeptide (SEQ ID NO:24) encoded by SEQ ID NO:23 is 145 amino acid residues and is presented using the one-letter code in Table 5B. Signal P, Psort and/or Hydropathy results predict that NOV5 has no signal peptide and is likely to be localized in the nucleus with a certainty of 0.9775. In other embodiments, NOV5 may also be localized to the microbody (peroxisome) with acertainty of 0.3925, the mitochondrial matrix space with a certainty of 0.3600, or the lysosome (lumen) with a certainty of 0.1000.

TABLE 5B

| Encoded NOV5 protein sequence (SEQ ID NO:24) |
| --- |
| MVTTQQLLGRWRPAERKYLKETGMRMALQKIGAMTKPDGAISDGKSFTIKTKSTLKTTRFSSKLGEKYERTT |
| GDGRKNSLFVCNFTKRALVQHWEWDEERKTRRRKVGDKKAGMECIMNNVTCTQICENKKSRIKISLLLWRAI |
| S |

The disclosed NOV5 amino acid sequence has 80 of 132 amino acid residues (60%) identical to, and 96 of 132 amino acid residues (72%) similar to, the 135 amino acid residue ptnr:SWISSPROT-ACC:P55052 protein from Bos taurus (Bovine) (Fatty Acid-Binding Protein, Epidermal (E-FABP) (Differentiation-Associated Lipid Binding Protein LP2)) (E 0.0).

NOV5 is expressed in at least retina. This information was derived by determining the tissue sources of the sequences that were included in the invention including but not limited to SeqCalling sources, Public EST sources, Literature sources, and/or RACE sources.

NOV5 also has homology to the amino acid sequences shown in the BLASTP data listed in Table 5C.

TABLE 5C

BLAST results for NOV5

| Gene Index/ Identifier | Protein/Organism | Length (aa) | Identity (%) | Positives (%) | Expect |
| --- | --- | --- | --- | --- | --- |
| gi\|6648071\|sp\|P55052\| FABE_BOVIN | FATTY ACID-BINDING PROTEIN, EPIDERMAL (E-FABP) | 135 | 80/133 (60%) | 96/133 (72%) | 4e-32 |
| gi\|1293786\|gb\|AAB41297.1\| (U55188) | LP2 [Bos taurus] | 135 | 80/133 (60%) | 96/133 (72%) | 7e-32 |
| gi\|4557581\|ref\|NP_001435.1\| (NM_001444) | fatty acid binding protein 5 (psoriasis-associated); E-FABP [Homo sapiens] | 135 | 79/133 (59%) | 95/133 (71%) | 7e-31 |
| gi\|13651882\|ref\|XP_011655.5\| (XM_011655) | similar to fatty acid binding protein 5 (psoriasis-associated); E-FABP (H. sapiens) [Hamo sapiens] | 135 | 73/133 (54%) | 93/133 (69%) | 2e-28 |
| gi\|1836058\|gb\|AAB46848.1\| (S83247) | DA11 [Rattus sp.] | 135 | 65/133 (48%) | 88/133 (65%) | 2e-25 |

The homology of these sequences is shown graphically in the ClustalW analysis shown in Table 5D.

TABLE 5D

Clustal W Sequence Alignment

```
1) NOV5 (SEQ ID NO:24)
2) gi|6648071|sp|P55052|FABE_BOVIN FATTY ACID-BINDING PROTEIN, EPIDERMAL (E-FABP)
(SEQ ID NO:82)
3) gi|1293786|gb|AAB41297.1| (U55188) LP2 [Bos taurus] (SEQ ID NO:83)
4) gi|4557581|ref|NP_001435.1| (NM_001444) fatty acid binding protein 5
(psoriasis-associated); E-FABP [Homo sapiens] (SEQ ID NO:84)
5) gi|13651882|ref|XP_011655.5| (XM_011655) similar to fatty acid binding protein 5
(psoriasis-associated); E-FABP (H. sapiens) [Homo sapiens] (SEQ ID NO:85)
6) gi|1836058|gb|AAB46848.1| (S83247) DA11 [Rattus sp.] (SEQ ID NO:86)

10         20         30         40         50         60
                     ....|....|....|....|....|....|....|....|....|....|....|....|
NOV5                 MVTTQQLLGRWRPAERK----YSKETGKRMALSKEGAMIKPDGAIK-DGKSFTIKTKSTL     55
gi|6648071|sp|p      MATVQQLVGRWRLVESKGFDEYMKEVGVGFALRKVGAMAKPDCIITSDGKNLSIKTESTL     60
gi|1293786|gp|A      MATVQQLVGRWRLVESKGFDEYMKEVGVGFALRKVGAMAKPDCIITSDGKNPSIKTESTL     60
gi|4557581|ref|      MATVQQLEGRWRLVSKGFDEYMKEGGVGFALRKVGAMAKPDCIITCDGKNLTIKTESTL     60
gi|13651882|ref      MATVQQLEGRWRLVSKGFDEYMKEVGVGFALRKVDTRAKPDCIITCDGKNLSIKTESTL     60
gi|1836058|gp|A      MASTKDLEGKWRLVESHGFDYMKEVGVGFALRKVGAMAKPDCIITLDGNNLTVKTESTV     60

70         80         90        100        110        120
                     ....|....|....|....|....|....|....|....|....|....|....|....|
NOV5                 KTTRFSSKLCEKXERTTGDGRKNSLFVCKFTKRALVQHWEWDEERKTRRRKVGDKKAGMK    115
gi|6648071|sp|p      KTTQFSCKLGEKFEETTADGRK-TQTVCKFTDGALVQHQEWDGKESTITRKLSDGKLVVV    119
gi|1293786|gp|A      KTTQFSCKLGEKFEETTADGRK-TQTVCKFTDGALVQHQEWDGKESTITRKLSDGKLVVV    119
gi|4557581|ref|      KTTQFSCTLGEKFEETTADGRK-TQTVCKFTDGALVQHQEWDGKESTITRKLSDGKLVVK    119
gi|13651882|ref      KTTQFSCTLGENFEETTADGRK-TQTVCKFTDGALVQHQEWDGKESTITRRKLSDGKLVVV    119
gi|1836058|gp|A      KTTVFSCTLGEKFSETTADGRK-TSTVCIFTDGALVQHQKWSGKESTITRKLNDGKVVVS    119
```

TABLE 5D-continued

Clustal W Sequence Alignment

```
                         130       140       150
                 ....|....|....|....|....|....|
NOV5             C MNNVTCT  C NK SRIKISLLLWRAIS          145
gi|6648071|sp|p  CVMNNVTCTR YEKVE--------------          135
gi|1293786|gp|A  CVMNNVTCTR YEKVE--------------          135
gi|4557581|ref|  CVMNNVTCTR YEKVE--------------          135
gi|13651882|ref  CVMN VTCTR YEKVE--------------          135
gi|1836058|gp|A  CVMNNAICTR YEKV --------------          135
```

The fatty acid-binding protein (FABP) family consists of small, cytosolic proteins believed to be involved in the uptake, transport, and solubilization of their hydrophobic ligands. Members of this family have highly conserved sequences and tertiary structures. Using an antibody against testis lipid-binding protein, a member of the FABP family, a protein was identified from bovine retina and testis that coeluted with exogenously added docosahexaenoic acid during purification. Amino acid sequencing and subsequent isolation of its cDNA revealed it to be nearly identical to a bovine protein expressed in the differentiating lens and to be the likely bovine homologue of the human epidermal fatty acid-binding protein (E-FABP). From quantitative Western blot analysis, it was estimated that bovine E-FABP comprised 0.9%, 0.1%, and 2.4% of retina, testis, and lens cytosolic proteins, respectively. Binding studies using the fluorescent probe ADIFAB indicated that this protein bound fatty acids of differing levels of saturation with relatively high affinities. Kd values ranged from 27 to 97 nM. In addition, the protein was immunolocalized to the Muller cells in the retina as well as to Sertoli cells in the testis. The location of bovine E-FABP in cells known to be supportive to other cell types in their tissues and the ability of E-FABP to bind a variety of fatty acids with similar affinities indicate that it may be involved in the uptake and transport of fatty acids essential for the nourishment of the surrounding cell types.

The disclosed NOV5 nucleic acid of the invention encoding a Fatty Acid-Binding Protein, Epidermal-like protein includes the nucleic acid whose sequence is provided in Table 5A or a fragment thereof. The invention also includes a mutant or variant nucleic acid any of whose bases may be changed from the corresponding base shown in Table 5A while still encoding a protein that maintains its Fatty Acid-Binding Protein, Epidermal-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 24 percent of the bases may be so changed.

The disclosed NOV5 protein of the invention includes the Fatty Acid-Binding Protein, Epidermal-like protein whose sequence is provided in Table 5B. The invention also includes a mutant or variant protein any of whose residues may be changed from the corresponding residue shown in Table 5B while still encoding a protein that maintains its Fatty Acid-Binding Protein, Epidermal-like activities and physiological functions, or a functional fragment thereof. In the mutant or variant protein, up to about 52 percent of the residues may be so changed.

The NOV5 nucleic acids and proteins of the invention are useful in potential therapeutic applications implicated in psoriasis, basal and squamous cell carcinomas, obesity, diabetis, and/or other pathologies and disorders involving fatty acid transport of skin, oral mucosa, and/or other diseases, disorders and conditions of the like. The NOV5 nucleic acid, or fragments thereof, may further be useful in diagnostic applications, wherein the presence or amount of the nucleic acid or the protein are to be assessed.

NOV5 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV5 protein have multiple hydrophilic regions, each of which can be used as an immunogen. This novel protein also has value in development of powerful assay system for functional analysis of various human disorders, which will help in understanding of pathology of the disease and development of new drug targets for various disorders.

NOV6

A disclosed NOV6 nucleic acid of 816 nucleotides (also referred to as CG50261-02) encoding a novel Uncoupling Protein I-like protein is shown in Table 6A. An open reading frame was identified beginning with an ATG initiation codon at nucleotides 1–3 and ending with a TAA codon at nucleotides 814–816. The start and stop codons are in bold letters in Table 6A.

TABLE 6A

NOV6 Nucleotide Sequence (SEQ ID NO:25)

ATGGGGGGCCTGACAGCCTCGGACGTACACCCGACCCTGGGGGTCCAGCTCTTCTCAGCTGGAATAGCGG

CGTGCTTGGCGGACGTGATCACCTTCCCGCTGGACACGGCCAAAGTCCGGCTCCAGGTCCAAGGTGAATG

TABLE 6A-continued

NOV6 Nucleotide Sequence (SEQ ID NO:25)

CCCGACGTCCAGTGTTATTAGGTATAAAGGTGTCCTGGGAACAATCACCGCTGTGGTAAAAACAGAAGGG

CGGATGAAACTCTACAGCGGGCTGCCTGCGGGGCTTCAGCGGCAAATCAGCTCCGCCTCTCTCAGGATCG

GCCTCTACGACACGGTCCAGGAGTTCCTCACCGCAGGGAAAGAAACAGCACCTAGTTTAGGAAGCAAGAT

TTTAGCTGGTCTAACGACTGGAGGAGTGGCAGTATTCATTGGGCAACCCACAGAGGTCGTGAAAGTCAGA

CTTCAAGCACAGAGCCATCTCCACGGAATCAAACCTCGCTACACGGGGACTTATAATGCGTACAGAATAA

TAGCAACAACCGAAGGCTTGACGGGTCTTTGGAAAGGGACTACTCCCAATCTGATGAGAAGTGTCATCAT

CAATTGTACAGAGCTAGTAACATATGATCTAATGAAGGAGGCCTTTGTGAAAAACAACATATTAGCAGGA

CAGTACAAAAGTGTGCCCAACTGTGCAATGAAAGTGTTCACTAACGAAGGACCAACGGCTTTCTTCAAGG

GGTTGGTACCTTCCTTCTTGCGACTTGGATCCTGGAACGTCATTATGTTTGTGTGCTTTGAACAACTGAA

ACGAGAACTGTCAAAGTCAAGGCAGACTATGGACTGTGCCACATAA

The disclosed NOV6 nucleic acid sequence, located on chromosome 4, has 628 of 628 bases (100%) identical to a gb:GENBANK-ID:HSU28480|acc:U28480.1 mRNA from *Homo sapiens* (Human uncoupling protein (UCP) mRNA, complete cds) (E=1.1e$^{-176}$).

A disclosed NOV6 polypeptide (SEQ ID NO:26) encoded by SEQ ID NO:25 is 271 amino acid residues and is presented using the one-letter amino acid code in Table 6B.

Signal P, Psort and/or Hydropathy results predict that NOV6 contains no signal peptide and is likely to be localized extracellularly with a certainty of 0.4753. In other embodiments, NOV6 is also likely to be localized to the plasma membrane with a certainty of 0.1900, to the microbody (peroxisome) with a certainty of 0.1544, or to the endoplasmic reticulum (membrane) with a certainty of 0.1000

TABLE 6B

Encoded NOV6 protein sequence (SEQ ID NO:26).

MGGLTASDVHPTLGVQLFSAGIAACLADVITFPLDTAKVRLQVQGECPTSSVIRYKGVLGTITAVVKTEGRMKLY

SGLPAGLQRQISSASLRIGLYDTVQEFLTAGKETAPSLGSKILAGLTTGGVAVFIGQPTEVVKVRLQAQSHLHGI

KPRYTGTYNAYRIIATTEGLTGLWKGTTPNLMRSVIINCTELVTYDLMKEAFVKNNILAGQYKSVPNCAMKVFTN

EGPTAFFKGLVPSFLRLGSWNVIMFVCFEQLKRELSKSRQTMDCAT

The disclosed NOV6 amino acid sequence has 209 of 209 amino acid residues (100%) identical to, and 209 of 209 amino acid residues (100%) similar to, the 307 amino acid residue ptru:pir-id:G01 858 protein from human (uncoupling protein 1, mitochondrial) (E=4.8e$^{-140}$).

NOV6 is expressed in at least the following tissues: Adrenal Gland/Suprarenal gland and Brown adipose. This information was derived by determining the tissue sources of the sequences that were included in the invention including but not limited to SeqCalling sources, Public EST sources, Literature sources, and/or RACE sources.

NOV6 also has homology to the amino acid sequences shown in the BLASTP data listed in Table 6C.

TABLE 6C

BLAST results for NOV6

| Gene Index/<br>Identifier | Protein/Organism | Length<br>(aa) | Identity<br>(%) | Positives<br>(%) | Expect |
|---|---|---|---|---|---|
| gi\|11225256\|ref\|NP_068605.1\|<br>(NM_021833) | uncoupling<br>protein 1;<br>thermogenin;<br>mitochondrial<br>brown fat | 307 | 271/307<br>(88%) | 271/307<br>(88%) | e-144 |

TABLE 6C-continued

BLAST results for NOV6

| Gene Index/ Identifier | Protein/Organism | Length (aa) | Identity (%) | Positives (%) | Expect |
|---|---|---|---|---|---|
| | uncoupling protein [*Homo sapiens*] | | | | |
| gi|1351353|sp|P25874| UCP1_HUMAN | MITOCHONDRIAL BROWN FAT UNCOUPLING PROTEIN 1 (UCP 1) (THERMOGENIN) | 307 | 270/307 (87%) | 270/307 (87%) | e-143 |
| gi|136689|sp|P14271| UCP1_RABIT | MITOCHONDRIAL BROWN FAT UNCOUPLING PROTEIN 1 (UCP 1) (THERMOGENIN) | 306 | 226/307 (73%) | 245/307 (79%) | e-117 |
| gi|109392|pir||A32446 | uncoupling protein - rabbit | 306 | 225/307 (73%) | 245/307 (79%) | e-117 |
| gi|1351354|sp|P04575| UCP1_MESAU | MITOCHONDRIAL BROWN FAT UNCOUPLING PROTEIN 1 (UCP 1) (THERMOGENIN) | 307 | 216/303 (71%) | 238/303 (78%) | e-115 |

The homology of these sequences is shown graphically in the ClustalW analysis shown in Table 6D.

TABLE 6D

Information for the ClustalW proteins

```
1) NOV6 (SEQ ID NO:26)
4) gi|11225256|ref|NP_068605.1| (NM_021833) uncoupling protein 1; thermogenin;
mitochondrial brown fat uncoupling protein [Homo sapiens] (SEQ ID NO:87)
5) gi|1351353|sp|P25874|UCP1_HUMAN MITOCHONDRIAL BROWN FAT UNCOUPLING PROTEIN 1
(UCP1) (THERMOGENIN) (SEQ ID NO:88)
6) gi|136689|sp|P14271|UCP1_RABIT MITOCHONDRIAL BROWN FAT UNCOUPLING PROTEIN 1
(UCP1) (THERMOGENIN) (SEQ ID NO:89)
7) gi|109392|pir||A32446 uncoupling protein - rabbit (SEQ ID NO:90)
6) gi|1351354|sp|P04575|UCP1_MESAU MITOCHONDRIAL BROWN FAT UNCOUPLING PROTEIN 1
(UCP1) (THERMOGENIN) (SEQ ID NO:91)
```

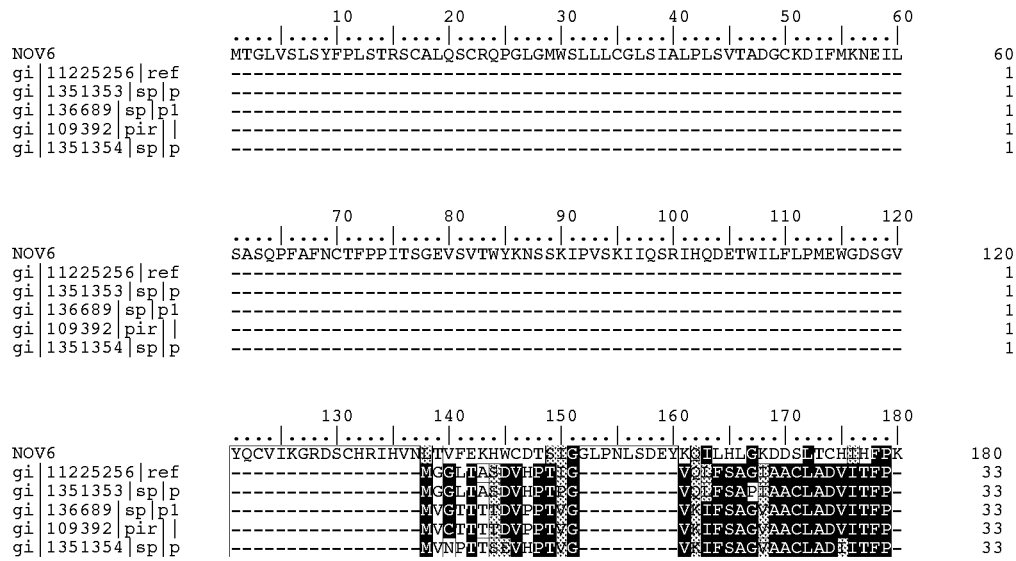

TABLE 6D-continued

Information for the ClustalW proteins

```
                      190       200       210       220       230       240
               ....|....|....|....|....|....|....|....|....|....|....|....|
NOV6           SCVLGPIKWYKDCNEIKGERFTVLETRLLVSNVSAEDRGNYACQSIETRSGKQYEVLNGI   240
gi|11225256|ref ---------------------------LDTAKVRLQVQGECPTSSVIRYKG----VLGTI    62
gi|1351353|sp|p ---------------------------LDTAKVRLQVQGECPTSSVIRYKG----VLGTI    62
gi|136689|sp|p1 ---------------------------LDTAKVRQQIQGEFPIRSGIRYKC----VLGTI    62
gi|109392|pir|  ---------------------------LDTAKVRQQIQGEFPIRSGIRYKG----VLGTI    62
gi|1351354|sp|p ---------------------------LDTAKVRLQIQGEGQISSTIRYKG----VLGTI    62

250       260       270       280       290       300
               ....|....|....|....|....|....|....|....|....|....|....|....|
NOV6           TVSISTTLIVDCNVTDIKDNTNLRCWRVNNTLVDDYYDESKRIREGVETHVSFREHNLYT   300
gi|11225256|ref TA-----------VVKTEGRMKLYSG---------------LPAGLQRQISSAS-----    90
gi|1351353|sp|p TA-----------VVKTEGRMKLYSG---------------LPAGLQRQISSAS-----    90
gi|136689|sp|p1 TT-----------LAKTEGPLKLYSG---------------LPAGLQRQISFAS-----    90
gi|109392|pir|  TT-----------LAKTEGPLKLYSG---------------LPAGLQRQISFAS-----    90
gi|1351354|sp|p TT-----------LAKTEGLPKLYSG---------------LPAGIQRQISFAS-----    90

310       320       330       340       350       360
               ....|....|....|....|....|....|....|....|....|....|....|....|
NOV6           VNITFLEVKMEDYGLPFMCHAGVSTAYIILQLPAPDFRAYLIGGKIALVAVAVSVVYKYN   360
gi|11225256|ref -----LRIGLYDTVQEFLTSGKETAP----SLGSKILAGLTTGGVAVFIGQPTEVVKVR-   140
gi|1351353|sp|p -----LRIGLYDTVQEFLTSGKETAP----SLGSKILAGLTTGGVAVFIGQPTEVVKVR-   140
gi|136689|sp|p1 -----LRIGLYDTVQEFFTSGKETP-----SLGSKISAGLTTGGVAVFIGQPTEVVKVR-   139
gi|109392|pir|  -----LRIGLYDTVQEFFTSGKETP-----SLGSKISAGLTTGGVAVFIGQPTEVVKVR-   139
gi|1351354|sp|p -----LRIGLYDTVQEYFSSGKETPP----SLGMRISAGLMTGGVAVFIGQPTEVVKVR-   140

370       380       390       400       410       420
               ....|....|....|....|....|....|....|....|....|....|....|....|
NOV6           IFKIDIVLWYRSAFHSTETIVDGKLYEAYVEYPKPHKESQRHAKDALVLNILPEXLERQC   420
gi|11225256|ref ------LQAQSHLHGSKPRYTG-TYNAYRIIATTEG------LTGLWKGTTPNLMRSVI   186
gi|1351353|sp|p ------LQAQSHLHGSKPRYTG-TYNAYRIIATTEG------LTGLWKGTTPNLMRSVI   186
gi|136689|sp|p1 ------LQAQSHLHGSKPRYTG-TYNAYRIIATTES------LTSLWKGTTPNLLRNVI   185
gi|109392|pir|  ------LQAQSHLHGSKPRYTG-TYNAYRIIATTES------LTSLWKGTTPNLLRNVI   185
gi|1351354|sp|p ------LQAQSHLHGSKPRYTG-TYNAYRIIATTES------FSTLWKGTTPNLLRNVI   186

430       440       450       460       470       480
               ....|....|....|....|....|....|....|....|....|....|....|....|
NOV6           GYKLFEFGRDEFPGQAVANVIDENVKLCRREIVEXVPESLGFGLLKNLSEEQIAVYSALI   480
gi|11225256|ref INCTELVTYDLMKEAFVKNNILADDVPCHLVSALIA-----GFCATAMSSPVDVVKTRF   240
gi|1351353|sp|p INCTELVTYDLMKEAFVKNNILADDVPCHLVSALIA-----GFCATAMSSPVDVVKTRF   240
gi|136689|sp|p1 INCTELVTYDLMKGALVRNEILADDVPCHFVSALIA-----GFCITLESSPVDVVKTRF   239
gi|109392|pir|  INCTELVTYDLMKGALVNNEILADDVPCHLVSALIA-----GFCITLESSPVDVVKTRF   239
gi|1351354|sp|p INCVELVTYDLMKGALVNNQILADDVPCHLVSAFVA-----GFCITTFLSPADVVKTRF   240

490       500       510       520       530       540
               ....|....|....|....|....|....|....|....|....|....|....|....|
NOV6           QEGMKVILVELEKIEDYTVMPESIQYEKQKIGAIRWHGDETEQSQCMNTKFWKTVRKHMP   540
gi|11225256|ref IN--------SPPGQYKSVPNCAMKVFTNEGPTAFFKGLVP--SFLRLGSWNVIMF---   286
gi|1351353|sp|p IN--------SPPGQYKSVPNCAMKVFTNEGPTAFFKGLVP--SFLRLGSWNVIMF---   286
gi|136689|sp|p1 IN--------SPPGQYASVPNCAMIMFTKEGPTAFFKGFVP--SFLRLGSWNVIMF---   285
gi|109392|pir|  IN--------SPPGQYASVPNCAMIMFTKEGPTAFFKGFVP--SFLRLGSWEVIMF---   285
gi|1351354|sp|p IN--------SLPGQYPSVPSCAMIMLTKEGPTAFFKGFVP--SFLKLASWNVIMF---   286

550       560       570
               ....|....|....|....|....|....|
NOV6           PRRCRPFPPVQLLQHTPCCRTAGPELGSRRKKCTLTTG                        578
gi|11225256|ref ---------------VCFEQLKRELSKSRQTMDCAT-                        307
gi|1351353|sp|p ---------------VCFEQLKRELSKSRQTMDCAT-                        307
gi|136689|sp|p1 ---------------VCFEKLKGELMRSRQTMDCAT-                        306
gi|109392|pir|  ---------------VCFEKLKGELSKSRQTVDCAT-                        306
gi|1351354|sp|p ---------------VCFEQLKKELSKSRQTVDCTT-                        307
```

Tables 6E–F list the domain description from DOMAIN analysis results against NOV6. This indicates that the NOV6 sequence has properties similar to those of other proteins known to contain this domain.

TABLE 6E

Domain Analysis of NOV6 gnl|Pfam|pfam00153, mito_carr, Mitochondrial carrier protein. (SEQ ID NO:92)
CD-Length = 96 residues, 95.8% aligned
Score = 81.6 bits (200), Expect = 5e-17

```
Query:  111 PSLGSKILAGLTTGGVAVFIGQPTEVVKVRLQAQSHLHGIKPRYTGTYNAYRIIATTEGL  170
              | ++|||   | +|  +   +|||  ||| |        +|   + ++ |     ||
Sbjct:    3 LSFLASLLAGGIAGAIAALVTYPLDVVKTRLQVQGS----SSKYKGILDCFKKIVKEEGR   58
```

TABLE 6E-continued

Domain Analysis of NOV6

```
Query:  171 TGLWKGTTPNLMRSVIINCTELVTYDLMKEAFVKNN               206
            ||+||  | |+|            ||+ +|+    |
Sbjct:   59 AGLYKGLGPTLLRVAPYAAIYFGTYEQLKKLLGKKL                94
```

TABLE 6F

Domain Analysis of NOV6 gnl|Pfam|pfam00153, mito_carr, Mitochondrial carrier protein. (SEQ ID NO:93)
CD-Length = 96 residues, 99.0% aligned
Score = 79.3 bits (194), Expect = 3e-16

```
Query:  10 HPTLGVQLFSAGIAACLADVITFPLDTAKVRLQVQGECPTSSVIRYKGVLGTITAVVKTE    69
           +    | + |||    +| ++|+|||  |  ||||||         +|||+|    +|| |
Sbjct:   2 PLSFLASLLAGGIAGAIAALVTYPLDVVKTRLQVQGSSS-----KYKGILDCFKKIVKEE    56

Query:  70 GRMKLYSGLPAGLQRQISSASLRIGLYDTVQEFLTAGKET                       109
           ||  || ||   ||    |++   | |+ +++ |
Sbjct:  57 GRAGLYKGLGPTLLRVAPYAAIYFGTYEQLKKLLGKKLGE                        96
```

The uncoupling protein (UCP) of mitochondria in brown adipose tissue is a specific component unique to mammalian cells. Complementary DNAs for rat and mouse UCP were isolated in several laboratories (Jacobson et al., 1985; Bouillaud et al., 1986; Ridley et al., 1986). The cDNAs have been used to determine the sequence of rat UCP and to monitor changes in UCP mRNA levels under various physiologic, pathologic, and pharmacologic circumstances. A controversy exists concerning the physiologic significance of brown adipose tissue in humans and its possible contribution to resistance to obesity (see 601665). There is, however, a large amount of evidence that this tissue is present in young infants and also in human adults in certain pathologic and nonpathologic situations.

Bouillaud et al. (1988) screened a human genomic library with a cDNA corresponding to the UCP of rat brown adipose tissue mitochondria. They succeeded in cloning a 0.5-kb fragment containing 2 intronic regions and 2 exonic regions. The exonic regions encode a sequence of 84 amino acids with a strong homology to the central domain of rat UCP. Southern analysis experiments suggested that there is 1 copy of the gene in the human, as there is in rodents. In Northern analysis experiments, the probe detected a specific 1.8-kb mRNA in human brown adipose tissue obtained from 6 patients with pheochromocytoma and from 1 patient with a hibemoma.

Cassard et al. (1990) found that the human UCP gene spans 13 kb and contains a transcribed region that covers 9 kb. It has 6 exons. The uncoupling protein has 305 amino acids and a molecular weight of 32,786.

Fletcher et al. (1991) mapped the Ucp gene to mouse chromosome 8 in a location between a segment that carries genes homologous to genes on human 8p, on the centromeric side, and a segment that carries genes homologous to human genes on 16 q, in the telomeric direction. Thus, the human homolog of Ucp is probably on either 8p or 16q. Using in situ hybridization, Cassard et al. (1990) assigned the human UCP gene to 4q31. They found that the primary structure of UCP is similar to that of ADP/ATP translocator of skeletal muscle (103220), the gene for which is also located on chromosome 4. Thus, the prediction from homology to the mouse did not hold up.

Brown adipose tissue, because of its capacity for uncoupled mitochondrial respiration, is an important site of facultative energy expenditure. It has been speculated that this tissue normally functions to prevent obesity. Surgical efforts to ablate or denervate the brown adipose tissue have been unsuccessful because of the diffuse deposits and substantial capacity for regeneration and hypertrophy. Lowell et al. (1993) used a transgenic toxigene approach to create 2 lines of transgenic mice with primary deficiency of brown adipose tissue. In constructing these transgenic mice, Lowell et al. (1993) used the regulatory elements of the gene for uncoupling protein to drive expression of the diphtheria toxin A chain (UCP-DTA) or an attenuated mutant. At 16 days, both lines had deficient brown fat and obesity. In one line, brown fat subsequently regenerated and obesity resolved. In the other line, the deficiency persisted and obesity, with its morbid complications, advanced. Obesity developed in the absence of hyperphagia, indicating that brown fat deficient mice have increased metabolic efficiency. As obesity progressed, transgenic animals developed hyperphagia. See also UCP2 (601693).

Uncoupling protein is a mitochondrial proton channel that is not coupled to oxidative phosphorylation. Therefore, when a proton gradient is established across the inner mitochondrial membrane, activation of the uncoupling protein leads to the uncoupled passage of protons through the channel and the generation of heat. Expression and activation of uncoupling proteins is usually mediated by the sympathetic nervous system and is directly controlled by norepinephrine. This mechanism is part of the adaptive response to cold temperatures. It also regulates energy balance. Manipulation of thermogenesis could be an effective strategy against obesity (Lowell et al., 1993). Enerback et al., (1997) determined the role of UCP in the regulation of body mass by targeted inactivation of the UCP gene in mice. They found that UCP-deficient mice consumed less oxygen after treatment with a beta-3-adrenergic receptor agonist and that they were sensitive to cold, indicating that thermoregulation was defective. However, this deficiency caused neither hyperphagia nor obesity in mice fed on either a standard or a high-fat diet. Enerback et al. (1997) proposed that the loss of UCP may be compensated by UCP2, a homolog of UCP that is ubiquitously expressed and is induced in the brown fat of UCP-deficient mice.

Adrenaline and noradrenaline, the main effectors of the sympathetic nervous system and adrenal medulla, respectively, are thought to control adiposity and energy balance through several mechanisms. They promote catabolism of triglycerides and glycogen, stimulate food intake when injected into the central nervous system, activate thermogenesis in brown adipose tissue, and regulate heat loss through modulation of peripheral vasoconstriction and piloerection. Thermogenesis in brown adipose occurs in response to cold and overeating, and there is an inverse relationship between diet-induced thermogenesis and obesity both in humans and animal models. As a potential model for obesity, Thomas and Palmiter (1997) generated mice that could not synthesize noradrenaline or adrenaline by inactivating the gene that encodes dopamine beta-hydroxylase (DBH; 223360). These mice were cold intolerant because they had impaired peripheral vasoconstriction and were unable to induce thermogenesis in brown adipose tissue through uncoupling protein (UCP I). The mutants had increased food intake but did not become obese because their basal metabolic rate (BMR) was also elevated. The unexpected increase in BMR was not due to hyperthyroidism, compensation by the widely expressed UCP2, or shivering. The failure of UCP1 expressed in $E.\ coli$ inclusion bodies to carry out fatty acid-dependent H(+) transport activity inclusion bodies made Echtay et al. (2000) seek a native UCP cofactor. They identified coenzyme Q (CoQ, or ubiquinone) as such a cofactor. On addition of CoQ(10) to reconstituted UCP1 from inclusion bodies, fatty acid-dependent proton transport reached the same rate as with native UCP1. The proton transport was highly sensitive to purine nucleotides and was activated only by oxidized but not reduced CoQ. Proton transport of native UCP1 correlated with the endogenous CoQ content.

The disclosed NOV6 nucleic acid of the invention encoding a Leucine-Rich Glioma-Inactivated Protein-like protein includes the nucleic acid whose sequence is provided in Table 6A or a fragment thereof. The invention also includes a mutant or variant nucleic acid any of whose bases may be changed from the corresponding base shown in Table 6A while still encoding a protein that maintains its Leucine-Rich Glioma-Inactivated Protein-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 10% percent of the bases may be so changed.

The disclosed NOV6 protein of the invention includes the Leucine-Rich Glioma-Inactivated Protein-like protein whose sequence is provided in Table 6B. The invention also includes a mutant or variant protein any of whose residues may be changed from the corresponding residue shown in Table 6B while still encoding a protein that maintains its Leucine-Rich Glioma-Inactivated Protein-like activities and physiological functions, or a functional fragment thereof. In the mutant or variant protein, up to about 29 percent of the residues may be so changed.

The above defined information for this invention suggests that these Leucine-Rich Glioma-Inactivated Protein-like proteins (NOV6) may function as a member of a "Leucine-Rich Glioma-Inactivated Protein family". Therefore, the NOV6 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The nucleic acids and proteins of NOV6 are useful in any inflammatory diseases such as obesity, hyperphagia, and/or other pathologies and disorders.

NOV6 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV6 protein have multiple hydrophilic regions, each of which can be used as an immunogen. This novel protein also has value in development of powerful assay system for functional analysis of various human disorders, which will help in understanding of pathology of the disease and development of new drug targets for various disorders.

NOV7

NOV7 includes three novel Leucine-Rich Glioma-Inactivated Protein-like proteins disclosed below. The disclosed sequences have been named NOV7a, and NOV7b.

NOV7a

A disclosed NOV7a nucleic acid of 1859 nucleotides (also referred to CG56077-01) encoding a novel Leucine-Rich Glioma-Inactivated Protein-like protein is shown in Table 7A. An open reading frame was identified beginning with an ATG initiation codon at nucleotides 101–103 and ending with a TGA codon at nucleotides 17601762. In Table 7A, the 5' and 3' untranslated regions are underlined and the start and stop codons are in bold letters.

TABLE 7A

NOV7a Nucleotide Sequence (SEQ ID NO:27)

GTAACTCCTCTTCATCCACTGGGGAGGAAGGTGAGGCAGGCGGGCCCAATTCATTCGCCTCCGGTACTTGC

AAGCCTCGCTCAGTCTTAAGCAAGAGGGGATGGATTCGCCCGCAGCACTGAGAATCCAGGGGCAGGCGGGA

TGGCGTTCAGGCGCTGTTGCTAGAAATCTCTGTCTTTACTCTGTTTTGGTCATTACGGAGGGAAGACAGCC

CCCAAAGGGAAAGTGTCCCCTGCGCTGCTCCTGCTCTAAAGACAGCGCCCTGTGTGAGGGCTCCCCGGACC

TGCCCGTCAGCTTCTCTCCGACCCTGCTGTCACTCTCACTCGTCAGGACGGGAGTCACCCAGCTGAAGGCC

GGCAGCTTCCTGAGAATTCCGTCTCTGCACCTGCTCCTCTTCACCTCCAACTCCTTCTCCGTGATTGAGGA

TABLE 7A-continued

NOV7a Nucleotide Sequence (SEQ ID NO:27)

CGATGCATTTGCGGGCCTGTCCCACCTGCAGTACCTCTTCATCGAGGACAATGAGATTGGCTCCATCTCTA

AGAATGCCCTCAGAGGACTTCGCTCGCTTACACACCTAAGCCTGGCCAATAACCATCTGGAGACCCTCCCC

AGATTCCTGTTCCGAGGCCTGGACACCCTTACTCATGTGGACCTCCGCGGGAACCCGTTCCAGTGTGACTG

CCGCGTCCTCTGGCTCCTGCAGTGGATGCCCACCGTGAATGCCAGCGTGGGGACCGGCGCCTGTGCGGGCC

CCGCCTCCCTGAGCCACATGCAGCTCCACCACCTCGACCCCAAGACTTTCAAGTGTAGAGCCATAGAGCTG

TCCTGGTTCCAGACGGTGGGGGAGTCGGCACTGAGCGTAGAGCCCTTCTCCTACCAAGGGGAGCCTCACAT

TGTGCTGGCACAGCCCTTCGCCGGCCGCTGCCTGATTCTCTCCTGGGACTACAGCCTGCAGCGCTTCCGGC

CCGAGGAAGAGCTGCCCGCGGCCTCCGTGGTGTCCTGCAAGCCACTGGTGCTGGGCCCGAGCCTCTTCGTG

CTGGCTGCCCGCCTGTGGGGGGGCTCACAGCTGTGGGCCCGGCCCAGTCCCGGCCTGCGCCTGGCCCCAAC

GCAGACCCTGGCCCCGCGGCGGCTGCTGCGGCCCAATGACGCCGAGCTCCTGTGGCTGGAAGGGCAACCCT

GCTTCGTGGTGGCCGATGCCTCCAAGGCGGGCAGCACCACGCTGCTGTGCCGCGACGGGCCCGGCTTTTAC

CCGCACCAGAGCCTGCACGCCTGGCACCGGGACACGGACGCTGAGGCCCTGGAGCTGGACGGCCGGCCCCA

CCTGCTGCTGGCCTCGGCTTCCCAGCGGCCCGTGCTCTTCCACTGGACCGGTGGCCGCTTCGAGAGACGCA

CAGACATCCCGAGGGCCGAGGATGTCTATGCCACACGCCACTTCCAGGCTGGTGGGGACGTGTTCCTGTGC

CTCACACGCTACATTGGGGACTCCATGGTCATGCGCTGGGACGGCTCCATGTTTCGTCTGCTGCAGCAACT

TCCCTCGCGCGGTGCCCACGTCTTCCAGCCACTGCTCATCGCCAGGGACCAGCTGGCCATCCTAGGCAGCG

ACTTCGCCTTCAGCCAGGTCCTCCGCCTTGAGCCTGACAAGGGGCTCCTGGAGCCACTGCAGGAGCTGGGG

CCTCCGGCCCTGGTGGCCCCCCGTGCCTTTGCCCACATCACTATCGCCGGCAGACGCTTCCTCTTTGCTGC

TTGCTTTAAGGGCCCCACACAGATCTACCAGCATCACGAGATCGACCTCAGTGCCTGA<u>GACCACCAACGGG</u>

<u>ACTCTGGGCATGGCTGGGGCCCCTGGACGGCCCCTTGGCTGGCTCCTGGCCCTACTTGGGGTGATGGCCCG</u>

<u>CCTGTGAGCTGCT</u>

The disclosed NOV7a nucleic acid sequence, localized to the q12 region of chromosome 19, has 940 of 1619 bases (58%) identical to a gb:GENBANK-ID:HSU53204|acc:U53204.1 mRNA from *Homo sapiens* (Human plectin (PLEC 1) mRNA, complete cds) (E= 7.0e$^{-301}$).

A disclosed NOV7a polypeptide (SEQ ID NO:28) encoded by SEQ ID NO:27 is 553 amino acid residues and is presented using the one-letter amino acid code in Table 7B. Signal P, Psort and/or Hydropathy results predict that NOV7a has a signal peptide and is likely to be localized in the microbody (peroxisome) with a certainty of 0.6562. In other embodiments, NOV7A is also likely to be localized to the lysosome (lumen) with a certainty of 0.2474, or to the mitochondrial matrix space with a certainty of 0.1000.

TABLE 7B

Encoded NOV7a protein sequence (SEQ ID NO:28).

MDSPAALRIQGQAGWRSGAVARNLCLYSVLVITEGRQPPKGKCPLRCSCSKDSALCECSPDLPVSFSPTLL

SLSLVRTGVTQLKAGSFLRIPSLHLLLFTSNSFSVIEDDAFAGLSHLQYLFIEDNEIGSISKNALRGLRSL

THLSLANNHLETLPRFLFRGLDTLTHVDLRGNPFQCDCRVLWLLQWMPTVNASVGTGACAGPASLSHMQLH

HLDPKTFKCRAIELSWFQTVGESALSVEPFSYQGEPHIVLAQPFAGRCLILSWDYSLQRFRPEEELPAASV

VSCKPLVLGPSLFVLAARLWGGSQLWARPSPGLRLAPTQTLAPRRLLRPNDAELLWLEGQPCEVVADASKA

GSTTLLCRDGPGFYPHQSLHAWHRDTDAEALELDGRPHLLLASASQRPVLFHWTGGRFERRTDIPRAEDVY

ATRHFQAGGDVFLCLTRYIGDSMVMRWDGSMFRLLQQLPSRGAHVFQPLLIARDQLAILGSDFAFSQVLRL

EPDKGLLEPLQELGPPALVAPRAFAHITMAGRRFLFAACFKGPTQIYQHHEIDLSA

The disclosed NOV7a amino acid sequence has 274 of 557 amino acid residues (49%) identical to, and 380 of 557 amino acid residues (68%) similar to, the 557 amino acid residue ptnr:SPTREMBL-ACC:Q9JIA1 protein from *Mus musculus* (Mouse) (Leucine-Rich Glioma-Inactivated 1 Protein Precursor) (E=2.5e$^{-143}$).

NOV7β is expressed in at least the following tissues: Adipose, Brain, Cervix, Heart, Hippocampus, Hypothalamus, Kidney Cortex, Liver, Lung, Myometrium, Nasoepithelium, Pancreas, Prostate, Retina, Small Intestine, Spinal Chord, Stomach, Substantia Nigra, Testis, Thalamus, Thymus, Vein. This information was derived by determining the tissue sources of the sequences that were included in the invention including but not limited to SeqCalling sources, Public EST sources, Literature sources, and/or RACE sources.

In addition, the sequence is predicted to be expressed in skin and muscle because of the expression pattern of (GENBANK-ID: gb:GENBANK-ID:HSU53204|acc:U53204.1) a closely related Human plectin (PLEC 1) mRNA, complete cds homolog.

NOV7b

In the present invention, the target sequence identified previously, NOV7a, was subjected to the exon linking process to confirm the sequence. PCR primers were designed by starting at the most upstream sequence available, for the forward primer, and at the most downstream sequence available for the reverse primer. In each case, the sequence was examined, walking inward from the respective termini toward the coding sequence, until a suitable sequence that is either unique or highly selective was encountered, or, in the case of the reverse primer, until the stop codon was reached. Such primers were designed based on in silico predictions for the full length cDNA, part (one or more exons) of the DNA or protein sequence of the target sequence, or by translated homology of the predicted exons to closely related human sequences sequences from other species. These primers were then employed in PCR amplification based on the following pool of human cDNAs: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. Usually the resulting amplicons were gel purified, cloned and sequenced to high redundancy. The resulting sequences from all clones were assembled with themselves, with other fragments in CuraGen Corporation's database and with public ESTs. Fragments and ESTs were included as components for an assembly when the extent of their identity with another component of the assembly was at least 95% over 50 bp. In addition, sequence traces were evaluated manually and edited for corrections if appropriate. These procedures provide the sequence reported below, which is designated Accession Number NOV7b. This differs from the previously identified sequence (Accession Number NOV7a) in being a splice variant.

A disclosed NOV7b nucleic acid of 1482 nucleotides (also referred to CG56077-02) encoding a novel Leucine-Rich Glioma-Inactivated Protein-like protein is shown in Table 7C.

An open reading frame was identified beginning with an TTC initiation codon at nucleotides 1–3 and ending with a TGA codon at nucleotides 1480–1482. In Table 7C, the 5' and 3' untranslated regions are underlined and the start and stop codons are in bold letters. Because the start codon for NOV7b is not a traditional initiation codon, NOV7b may be a partial reading frame that extends further in the 5' direction.

TABLE 7C

NOV7b Nucleotide Sequence (SEQ ID NO:29)

TCCCGAGACTTTGGAAGTTCTCAGCTATTACTTTATTACATAGGATTTCTGTGTCTTTTCTCATCTCTTTT

CCTTTTGGAAATTGGAAGACCCCCAAAGGGAAAGTGTCCCCTGCGCTGCTCCTGCTCTAAAGACAGCGCCC

TGTGTGAGGGCTCCCCGGACCTGCCCGTCAGCTTCTCTCCGACCCTGCTGTCACTGACTGCCCACATCCCC

AGCTCACTCGTCAGGACGGGAGTCACCCAGCTGAAGGCCGGCAGCTTCCTGAGAATTCCGTCTCTGCACCT

GCTGCTCTTCACCTCCAACTCCTTCTCCGTGATTGAGGACGATGCATTTGCGGGCCTGTCCCACCTGCAGT

ACCTGTTCATCGAGGACAATGAGATTGGCTCCATCTCTAAGAATGCCCTCAGAGGACTTCGCTCGCTTACA

CACCTGAGCCTGGCCAATAACCATCTGGAGACCCTCCCCAGATTCCTGTTCCGAGGCCTGGACACCCTTAC

TCATGTGGACCTCCGCGGGAACCCGTTCCAGTGTGACTGCCGCGTCCTCTGGCTCCTGCAGTGGATGCCCA

CCGTGAATGCCAGCGTGGGGACCGGCGCCTGTGCGGGCCCCGCCTCCCTGAGCCACATGCAGCTCCACCAC

CTCGACCCCAAGACTTTCAAGTGCACAGCGGCCTCCGTGGTGTCCTGCAAGCCACTGGTGCTGGGCCCGAG

CCTCTTCGTGCTGGCTGCCCGCCTGTGGGGGGCTCACAGCTGTGGGCCCGGCCCAGTCCCGGCCTGCGCC

TGGCCCCAACGCAGACCCTGGCCCCGCGGCGGCTGCTGCGGCCCAATGACGCCGAGCTCCTGTGGCTGGAA

GGGCAACCCTGCTTCGTGGTGGCCGATGCCTCCAAGGCGGGCAGCACCACGTGCAGCGCTTCCGGCCCGAG

GAAGAGCTGCCCGAGCCTGCACGCCTGGCACCGGGACACGGACGCTGAGGCCCTGGAGCTGGACGGCCGGC

CCCACCTGCTGCTGGCCTCGGCTTCCCAGCGGCCCGTGCTCTTCCACTGGACCGGTGGCCGCTTCGAGAGA

CGCACGGACATCCCCGAGGCCGAGGATGTCTATGCCACACGCCACTTCCAGGCTGGTGGGGACGTGTTCCT

GTGCCTCACACGCTACATTGGGGACTCCATGGTCATGCGCTGGGACGGCTCCATCTTTCGTCTGCTGCAGC

TABLE 7C-continued

NOV7b Nucleotide Sequence (SEQ ID NO:29)

AACTTCCCTCGCGCGGTGCCCACGTCTTCCAGCCACTGCTCATCGCCAGGGACCAATTGGCCATCCTAGGC

AGCGACTTCGCCTTCAGCCAGGTCCTCCGCCTTGAGCCTGACAAGGGGCTCCTGGAGCCACTGCAGGAGCT

GGGGCCTCTGGCCCTGGTGGCCCCCCGTGCCTTTGCCCACATCACTATGGCCGGCAGACGCTTCCTCTTTG

CTGCTTGCTTTAAGGGCCCCACACAGATCTACCAGCATCACGAGATCGACCTCAGTGCCTGA

The disclosed NOV7b nucleic acid sequence, localized to the q24 region of chromosome 10, has 559 of 919 bases (60%) identical to a gb:GENBANK-ID:SC6D10|acc:AL138538.1 mRNA from *Streptomyces coelicolor* A3(2) (*Streptomyces* coeticolor cosmid 6D10) (E=9.8e$^{-10}$).

A disclosed NOV7b polypeptide (SEQ ID NO:30) encoded by SEQ ID NO:29 is 493 amino acid residues and is presented using the one-letter amino acid code in Table 7D. Signal P, Psort and/or Hydropathy results predict that NOV7b has a signal peptide and is likely to be localized in the endoplasmic reticulum (membrane) with a certainty of 0.8200. In other embodiments, NOV7b is also likely to be localized to the microbody (peroxisome) with a certainty of 0.3264, to the plasma membrane with a certainty of 0.1900, or to the endoplasmic reticulum (lumen) with a certainty of 0.1000. The most likely cleavage site for NOV7b is between positions 25 and 26: LFL-LE.

TABLE 7D

Encoded NOV7b protein sequence (SEQ ID NO:30).

SRDPGSSQLLLYYIGFLCLFSSLFLLEIGRPPKGKCPLRCSCSKDSALCEGSPDLPVSFSPTLLSLTAHIP

SSLVRTGVTQLKAGSFLRIPSLHLLLFTSNSFSVIEDDAFAGLSHLQYLFIEDNEIGSISKNALRGLRSLT

HLSLANNHLETLPRFLFRGLDTLTHVDLRGNPFQCDCRVLWLLQWMPTVNASVGTGACAGPASLSHMQLHH

LDPKTFKCTAASVVSCKPLVLCPSLFVLAARLWGGSQLWARPSPGLRLAPTQTLAPRRLLRPNDAELLWLE

GQPCFVVADASKAGSTTCSASGPRKSCPSLHAWHRDTDAEALELDGRPHLLLASASQRPVLFHWTGGRFER

RTDIPEAEDVYATRHFQAGGDVFLCLTRYIGDSMVMRWDCSMFRLLQQLPSRGAHVFQPLLTARDQLAILG

SDPAFSQVLRLEPDKGLLEPLQELGPLALVAPRAFAHITMAGRRFLFAACFKGPTQIYQHHEIDLSA

The disclosed NOV7b amino acid sequence has 137 of 295 amino acid residues (46%) identical to, and 191 of 295 amino acid residues (64%) similar to, the 557 amino acid residue ptnr:SPTREMBL-ACC:Q9JIA1 protein from *Mus musculus* (Mouse) (Leucine-Rich Glioma-Inactivated 1 Protein Precursor) (E=5.7e$^{-122}$).

NOV7b is expressed in at least brain. Expression information was derived from the 110 tissue sources of the sequences that were included in the derivation of the sequence of CuraGen Acc. No. CG56077-02.

NOV7 also has homology to the amino acid sequence shown in the BLASTP data listed in Table 7E.

TABLE 7E

BLAST results for NOV7

| Gene Index/ Identifier | Protein/Organism | Length (aa) | Identity (%) | Positives (%) | Expect |
|---|---|---|---|---|---|
| gi\|9938002\|ref\|NP_064674.1\| (NM_020278) | leucine-rich, glioma inactivated 1 [*Mus musculus*] | 557 | 271/561 (48%) | 376/561 (66%) | e-157 |
| gi\|4826816\|ref\|NP_005088.1\| (NM_005097) | leucine-rich, glioma inactivated 1 precursor [*Homo sapiens*] | 557 | 265/542 (48%) | 364/542 (66%) | e-151 |

TABLE 7E-continued

BLAST results for NOV7

| Gene Index/ Identifier | Protein/Organism | Length (aa) | Identity (%) | Positives (%) | Expect |
|---|---|---|---|---|---|
| gi\|15722102\|emb\|CAC78757.1\| (AL358154) | bA512J3.1 (leucine-rich, glioma inactivated 1) [Homo sapiens] | 461 | 225/464 (48%) | 308/464 (65%) | e-129 |
| gi\|15620891\|dbj\|BAB67809.1\| (AB067503) | KIAA1916 protein [Homo sapiens] | 542 | 211/513 (41%) | 312/513 (60%) | e-113 |
| gi\|4590406\|gb\|AAD26567.1\| AF126540_1 (AF126540) | slit protein [Drosophila melanogaster] | 1504 | 58/187 (31%) | 89/187 (47%) | 2e-18 |

The homology of these sequences is shown graphically in the ClustalW analysis shown in Table 7F.

TABLE 7F

Information for the ClustalW proteins

1) Nove7 (SEQ ID NO:30)
2) gi|9938002|ref|NP_064674.1| (NM_020278) leucine-rich, glioma inactivated 1 [Mus musculus] (SEQ ID NO:94)
3) gi|4826816|ref|NP_005088.1| (NM_005097) leucine-rich, glioma inactivated 1 precursor [Homo sapiens] (SEQ ID NO:95)
4) gi|15722102|emb|CAC78757.1| (AL358154) bA512J3.1 (leucine-rich, glioma inactivated 1) [Homo sapiens] (SEQ ID NO:96)
5) gi|15620891|dbj|BAB67809.1| (AB067503) KIAA1916 protein [Homo sapiens] (SEQ ID NO:97)
6) gi|4590406|gb|AAD26567.1|AF126540_1 (AF126540) slit protein [Drosophila melanogaster] (SEQ ID NO:98)

```
                        10         20         30         40         50         60
                ....|....|....|....|....|....|....|....|....|....|....|....|
NOV7a           MDSPAALRIQGQAGWRSGAVARNLCLYSVLVITEGRQPPK----------------------     40
NOV7b           ------SRDFGSSQLLLYYEG-FLCLFSSLFELEIGRPPK----------------------     33
gi|9938002|ref| -MESESSRRMGNACIPLKRIAYFLCLFSVVIITEGKKPAK----------------------     39
gi|4826816|ref| -MESERSKRMGNACIPLKRIAYFLCLLSALIITEGKKPAK----------------------     39
gi|15722102|emb| -------------------------------------------------------------      1
gi|15620891|dbj| -------KRGG--CGALG-ELLLILGAACIIPRSAQVRRL----------------------     30
gi|4590406|gb|A ---MAAPSRTTLMPPPFRLQLRLLILPILEKRHDAVHAEPYSGGFGSSAVSSGGLGSVG       57

70         80         90        100        110        120
                ....|....|....|....|....|....|....|....|....|....|....|....|
NOV7a           --------------GKCPLRCSCKQSALCEGS--PDLPVSFSPTLLSL------SLVRTG     79
NOV7b           --------------GKCPLRCSCKQSALCEGS--PDLPVSFSPTKLSLTAHIPSLVRTG    78
gi|9938002|ref| --------------PKCPAVCTCSKQNALCENA--RSLPRTVPPDVISL------SFVRSG     78
gi|4826816|ref| --------------PKCPAVCTCSKQNALCENA--RSLPRTVPPDVISL------SFVRSG     78
gi|15722102|emb| -------------------------------------------------------------      1
gi|15620891|dbj| --------------ARCPATCSCTKPSIICVGS--SWVPRIVGPDISSL------SLVNGT     69
gi|4590406|gb|A IHIPGGGVGVITEARCPRVCSCTGLNVDCSHRGLTSVPRKISADVERL------ELQGNN    111

130        140        150        160        170        180
                ....|....|....|....|....|....|....|....|....|....|....|....|
NOV7a           VTKKAGSELRIPSLHLLLFTSNSFSVIEDDAFAGLSHLQYLFIEDNPIGSISK------    133
NOV7b           VTKKAGSELRIPSLHLLLFTSNSFSVIEDDAFAGLSHLQYLFIENEIGSISK------    132
gi|9938002|ref| FTKRSEGSELFTPSLQLLLFTSNSFDVISDDAFIGLPHLEYLFIENNIRSISK------    132
gi|4826816|ref| FTKRSEGSELFTPSLQLLLFTSNSFDVISDDAFIGLPHLEYLFIENNIRSISK------    132
gi|15722102|emb| -------------LFTSNSFDVISDDAFIGLPHLEYLFIENNIRSISK------     36
gi|15620891|dbj| FKKRKDRMESHLPSLQLLLLNSNSFTRIRDDAAGLFHLEYLFIEGNKIRSISK------    123
gi|4590406|gb|A LIVKYETDPQRLIKLRMLQLTDNQIGYIPRKSFQDLVSLDRLRENNRKKALPENFVTSS    171

190        200        210        220        230        240
                ....|....|....|....|....|....|....|....|....|....|....|....|
NOV7a           --------------------------------------------NALRGLRSLTHLSLANNK    151
NOV7b           --------------------------------------------NALRGLRSLTHLSLANNK    150
gi|9938002|ref| --------------------------------------------NTFRGLRSLIHLSLANNK    150
gi|4826816|ref| --------------------------------------------NTFRGLRSLIHLSLANNK    150
gi|15722102|emb| --------------------------------------------NTFRGLRSLIHLSLANNK     54
gi|15620891|dbj| --------------------------------------------NAFRGLRDLTHLSLANNK    141
gi|4590406|gb|A ASLLRLDISNNVITTVGRRVFKGAQSLRSLQLDNNQITCLDEHAFKGLVELEILTLNNNK    231
```

TABLE 7F-continued

Information for the ClustalW proteins

```
                     250        260        270        280        290        300
                ....|....|....|....|....|....|....|....|....|....|....|....|
NOV7a           LETLPRFEFGLDSLTNVDLRGNPFQCDCRVLWLKQWKPTVNASVGTGACAGEASLSHMQ     211
NOV7b           LETLPRFEFGLDSLTNVDLRGNPFQCDCRVLWLKQWKPTVNASVGTGACAGEASLSHMQ     210
gi|9938002|ref| LTTLPKEEFKGLDSLTKVDLRGNAFNCDCKIKWLKEWLGHTNAIVEDIYCEGPPEYKKRK     210
gi|4826816|ref| LTTLPKEEFKGLDSLTKVDLRGNSFNCDCKIKWLKEWLGHTNAIVEDIYCEGPPEYKKRK     210
gi|15722102|emb LQTLPKDEFKGLDSLTNVDLRGNSFNCDCREKWLVEWLGHTNAIVEDIYCEGPPEYKKRK     114
gi|15620891|dbj IKALPRKYFSDLDSLIEEDLRGNKFECDCKAKWLYLWLKMTNSLYSDVLCIGPPEYEEKK     201
gi|4590406|gb|A LTELPHNKFGGLGRLRAKRLSDNPFACDCHISWLSRKLRSATRLAPYTRCQSPSQLKGEN    291

310        320        330        340        350        360
                ....|....|....|....|....|....|....|....|....|....|....|....|
NOV7a           LRHLDPKTEKCR--------------------------------------------AIEL     227
NOV7b           LRHLDPKTEKC-------------------------------------------------     221
gi|9938002|ref| INSLSPKEEDCI--------------------------------------------IEF     226
gi|4826816|ref| INSLSSKEEDCI--------------------------------------------IEF     226
gi|15722102|emb INSLSSKEEDCI--------------------------------------------IEF     130
gi|15620891|dbj LNDYTSFEYECT--------------------------------------------TEF     217
gi|4590406|gb|A VADLHDQEEKCSGLTEHAPMECGAENSCPHPCRCADGIVDCREKSLTSVPVTLPDDTEV    351

370        380        390        400        410        420
                ....|....|....|....|....|....|....|....|....|....|....|....|
NOV7a           SWFC----TVGESALS----VLPESYQGKPHIVEAQPFAG--------------------     259
NOV7b           ------------------------------------------------------------     221
gi|9938002|ref| AKSC----DLPYQSLS----IDTESYLNEYVVIAQPFTG--------------------     258
gi|4826816|ref| AKSC----DLPYQSLS----IDTESYLNEYVVIAQPFTG--------------------     258
gi|15722102|emb AKSC----DLPYQSLS----IDTESYLNEYVVIAQPFTG--------------------     162
gi|15620891|dbj VVHC----TLPYQSVS----VDTENSKNEVYVAIAQPSME--------------------     249
gi|4590406|gb|A RLEQNFITELPPKSFSSFRRLRRIDLSNNNISREAHDALSGLKQLTTLVLYGNKIKDLPS    411

430        440        450        460        470        480
                ....|....|....|....|....|....|....|....|....|....|....|....|
NOV7a           ---------RCEILSWDKS----LQRFRPEKEL---------------PAASVVSCKEI     290
NOV7b           ----------------------------------------------TAASVVSCKEI     232
gi|9938002|ref| ---------KCIFLEWDKY----EKTFRNYDNI---------------LGTSTVVCKEI     289
gi|4826816|ref| ---------KCIFLEWDKY----EKTFRNYDNI---------------LGTSTVVCKEI     289
gi|15722102|emb ---------KCIFLEWDKY----EKTFRNYDNI---------------LGTSTVVCKEI     193
gi|15620891|dbj ---------NCMVLEWDKE----EMNFRSYDNI---------------LGQSIVGCKAI     280
gi|4590406|gb|A GVFKGLGSLQLKLLNANEESCIRKDAFRDLHSESLLSLYDNNIQSLANGIFDAMKSIKTV    471

490        500        510        520        530        540
                ....|....|....|....|....|....|....|....|....|....|....|....|
NOV7a           VLGPSLKVLAARL-NGGSQLWAR--PSPGLRLAPTQTLAPRRLLRPND------------     335
NOV7b           VLGPSLKVLAARL-NGGSQLWAR--PSPGLRLAPTQTLAPRRLLRPND------------     277
gi|9938002|ref| VEDTQLYVEVAQL-FGGSHIYKR--DGFANRFIKIQDLEVLKIRKPND------------     334
gi|4826816|ref| VEETQLYVEVAQL-FGGSHIYKR--DSFANRFIKIQDIEILKIRKPND------------     334
gi|15722102|emb VEETQLYVEVAQL-FGGSHIYKR--DSFANRFIKIQDIEILKIRKPND------------     238
gi|15620891|dbj LIDDQVEVVVAQL-FGGSHIYKY--DESWTRFVKFQDIEVSRISKPND------------     325
gi|4590406|gb|A HLAKNPFICDCNLRWLADYLHKNPIETSGARCESPWRMHRRRIESLREEKPKCSWDELRM    531

550        560        570        580        590        600
                ....|....|....|....|....|....|....|....|....|....|....|....|
NOV7a           ------------------------------------AELLWLEGQPCEVVAD---     351
NOV7b           ------------------------------------AELLWLEGQPCEVVAD---     293
gi|9938002|ref| ------------------------------------IETFKIENNWYEVVAD---     350
gi|4826816|ref| ------------------------------------IETFKIENNWYEVVAD---     350
gi|15722102|emb ------------------------------------IETFKIENNWYEVVAD---     254
gi|15620891|dbj ------------------------------------IELFQIKEETFEVVAD---     341
gi|4590406|gb|A KLSGEVRMDSDCPAMCHCEGTTVDCTGRGLKEIPRDIPLHTTELLLNDNELGRISSDGLF    591

610        620        630        640        650        660
                ....|....|....|....|....|....|....|....|....|....|....|....|
NOV7a           -----------------------------ASKAGSTTELCRDGPGFYPHQSLHAWKRD     380
NOV7b           -----------------------------ASKAGSTTCSAS-GP-RKSCPSLHAWKRD     320
gi|9938002|ref| -----------------------------SSKAGFTTEYKWNGNGFYSHQSLHAWKRD     379
gi|4826816|ref| -----------------------------SSKAGFTTEYKWNGNGFYSHQSLHAWKRD     379
gi|15722102|emb -----------------------------SSKAGFTTEYKWNGNGFYSHQSLHAWKRD     283
gi|15620891|dbj -----------------------------SSKAGLSTEYKWNSKGFYSHQSLHEWFRD     370
gi|4590406|gb|A GRLPHLVKLELKRNQLTGIEPNAFEGASHIQELQLGENKEKEISNKMFLGLHQLKTLNLY    651

670        680        690        700        710        720
                ....|....|....|....|....|....|....|....|....|....|....|....|
NOV7a           TDAEALEKDG-------RPHLELAS-----ASQRPVLEHWTGG---------------R     412
NOV7b           TDAEALEKDG-------RPHLELAS-----ASQRPVLEHWTGG---------------R     352
gi|9938002|ref| TDVEYLEIARPPLAL-RTPHLELSS-----SSQRPVIYQWNKAT-------------QL     419
gi|4826816|ref| TDVEYLEIVRTPQTL-RTPHLELSS-----SSQRPVIYQWNKAT-------------QL     419
gi|15722102|emb TDVEYLEIVRTPQTL-RTPHLELSS-----SSQRPVIYQWNKAT-------------QL     323
gi|15620891|dbj TDAEFWKID---G----KSHLELSS-----RSQVPEIILQWNKSS------------KK     404
gi|4590406|gb|A DNQISCVIPGSFEHLNSLTSLNLASNPFNCNCHLAWFAWLRKKSLNGGQQRCGAPSKVR    711
```

TABLE 7F-continued

Information for the ClustalW proteins

```
                        730        740        750        760        770        780
                 ....|....|....|....|....|....|....|....|....|....|....|....|
NOV7a            FERRTDIPR------------AEDVYATRHFQAGGDVXXCLTR--------XIGDSMVM     451
NOV7b            FERRTDIPE------------AEDVYATRHFQAGGDVXXCLTR--------XIGDSMVM     391
gi|9938002|ref|  FTNQTDIPN------------MEDVYAVKHFSVKGDVXXCLTR--------XIGDSKVM     458
gi|4826816|ref|  FTNQTDIPN------------MEDVYAVKHFSVKGDVXXCLTR--------XIGDSKVM     458
gi|15722102|emb| FTNQTDIPN------------MEDVYAVKHFSVKGDVXXCLTR--------XIGDSKVM     362
gi|15620891|dbj| FVPHGDIEN------------MEDVLAVKSHRMQNTXXSLTR--------XIGDSRVM     443
gi|4590406|gb|A  DVQIKDEPNSEFKCSSENSEGCXGDGYCPPSCTCTGTVVRCSRNQLKEIPRGIPAXXSEX    771

790        800        810        820        830        840
                 ....|....|....|....|....|....|....|....|....|....|....|....|
NOV7a            RWDGSMFXLEQXPSRGAHVFQPLLIARDQLAILGSDPXFXQVLRLEPXKGLLEPLQELG     511
NOV7b            RWDGSMFXLEQXPSRGAHVFQPLLIARDQLALLGSDPAFXQVLRLEPXKGLLEPLQELG     451
gi|9938002|ref|  KWGSSFQDIQRNPSRGXMVFQPLQINKYQYAILGSDYXFXQVYNWEAXKAKFVKFQELN     518
gi|4826816|ref|  KWGSSFQDIQRNPSRGXMVFQPLQINKYQYAILGSDYXFXQVYNWEAXKAKFVKFQELN     518
gi|15722102|emb| KWGSSFQDIQRNPSRGXMVPQPLQINKYQYAILGSDYXFXQVYNWEAXKAKFVKFQELN     422
gi|15620891|dbj| RWNSKQFVEIQAXPSRGAMTLQPFSFKDNHYLALGSDYXFXQTYQWDKXKQLFKKFKDIY     503
gi|4590406|gb|A  YLESKEIEQIHYERIRHLRSLTRLDLSMNQITXL-SKNYXFANXTKLSTLIISMNKLQCLQ     830

850        860        870        880        890        900
                 ....|....|....|....|....|....|....|....|....|....|....|....|
NOV7a            PPAXVAP-----------------------RAFAHXTMAGRRXFLFAXCFKGPTQIYXHH     547
NOV7b            PLAXVAP-----------------------RAFAHXTMAGRRXFLFAXCFKGPTQIYXHH     487
gi|9938002|ref|  ---XQAP-----------------------RSFTHVXXNKRNXFLFASSFKGNTQIYXHV     551
gi|4826816|ref|  ---XQAP-----------------------RSFTHVXXNKRNXFLFASSFKGNTQIYXHV     551
gi|15722102|emb| ---XQAP-----------------------RSFTHVXXNKRNXFLFASSFKGNTQIYXHV     455
gi|15620891|dbj| ---XQAP-----------------------RSFTAVXSTDRRDXFLFASSFKGKTKIFXHI     536
gi|4590406|gb|A  RHAXSGLNNLRVLSLHGNRISMLPEGSFEDLKSLTHIXAXGSNPLYCDCGLKWFSDWIKLD     890

910        920        930        940        950        960
                 ....|....|....|....|....|....|....|....|....|....|....|....|
NOV7a            EXDLSA------------------------------------------------------     553
NOV7b            EXDLSA------------------------------------------------------     493
gi|9938002|ref|  IVDLSA------------------------------------------------------     557
gi|4826816|ref|  IVDLSA------------------------------------------------------     557
gi|15722102|emb| IVDLSA------------------------------------------------------     461
gi|15620891|dbj| IVDLSL------------------------------------------------------     542
gi|4590406|gb|A  YVXPGIARCAEPEQMKDKLILSTPSSSFVCRGRVRNDILAKCNACFEQPCQNQAQCVALP     950

970        980        990       1000       1010       1020
                 ....|....|....|....|....|....|....|....|....|....|....|....|
NOV7a            ------------------------------------------------------------     553
NOV7b            ------------------------------------------------------------     493
gi|9938002|ref|  ------------------------------------------------------------     557
gi|4826816|ref|  ------------------------------------------------------------     557
gi|15722102|emb| ------------------------------------------------------------     461
gi|15620891|dbj| ------------------------------------------------------------     542
gi|4590406|gb|A  QREYQCLCQPGYHGKHCEFMIDACYGNPCRNNATCTVLEEGRFSCQCAPGYTGARCETNI    1010

1030       1040       1050       1060       1070       1080
                 ....|....|....|....|....|....|....|....|....|....|....|....|
NOV7a            ------------------------------------------------------------     553
NOV7b            ------------------------------------------------------------     493
gi|9938002|ref|  ------------------------------------------------------------     557
gi|4826816|ref|  ------------------------------------------------------------     557
gi|15722102|emb| ------------------------------------------------------------     461
gi|15620891|dbj| ------------------------------------------------------------     542
gi|4590406|gb|A  DDCLGEIKCQNNATCIDGVESYKCECQPGFSGEFCDTKIQFCSPEFNPCANGAKCMDHFT    1070

1090       1100       1110       1120       1130       1140
                 ....|....|....|....|....|....|....|....|....|....|....|....|
NOV7a            ------------------------------------------------------------     553
NOV7b            ------------------------------------------------------------     493
gi|9938002|ref|  ------------------------------------------------------------     557
gi|4826816|ref|  ------------------------------------------------------------     557
gi|15722102|emb| ------------------------------------------------------------     461
gi|15620891|dbj| ------------------------------------------------------------     542
gi|4590406|gb|A  HYSCDCQAGFHGTNCTDNIDDCQNHMCQNGGTCVDGINDYQCRCPDDYTGKYCEGHNMIS    1130

1150       1160       1170       1180       1190       1200
                 ....|....|....|....|....|....|....|....|....|....|....|....|
NOV7a            ------------------------------------------------------------     553
NOV7b            ------------------------------------------------------------     493
gi|9938002|ref|  ------------------------------------------------------------     557
gi|4826816|ref|  ------------------------------------------------------------     557
gi|15722102|emb| ------------------------------------------------------------     461
gi|15620891|dbj| ------------------------------------------------------------     542
gi|4590406|gb|A  MMYPQTSPCQNHECKHGVCFQPNAQGSDYLCRCHPGYTGKWCEYLTSISFVHNNSFVELE    1190
```

TABLE 7F-continued

Information for the ClustalW proteins

```
                         1210       1220       1230       1240       1250       1260
                    ....|....|....|....|....|....|....|....|....|....|....|....|
NOV7a               ------------------------------------------------------------   553
NOV7b               ------------------------------------------------------------   493
gi|9938002|ref|     ------------------------------------------------------------   557
gi|4826816|ref|     ------------------------------------------------------------   557
gi|15722102|emb     ------------------------------------------------------------   461
gi|15620891|dbj     ------------------------------------------------------------   542
gi|4590406|gb|A     PLRTRPEANVTIVFSSAEQNGILMYDGQDAHLAVELFNGRIRVSYDVGNHPVSTMYSFEM  1250

1270       1280       1290       1300       1310       1320
                    ....|....|....|....|....|....|....|....|....|....|....|....|
NOV7a               ------------------------------------------------------------   553
NOV7b               ------------------------------------------------------------   493
gi|9938002|ref|     ------------------------------------------------------------   557
gi|4826816|ref|     ------------------------------------------------------------   557
gi|15722102|emb     ------------------------------------------------------------   461
gi|15620891|dbj     ------------------------------------------------------------   542
gi|4590406|gb|A     VADGKYHAVELLAIKKNFTLRVDRGLARSIINEGSNDYLKLTTPMFLGGLPVDPAQQAYK  1310

1330       1340       1350       1360       1370       1380
                    ....|....|....|....|....|....|....|....|....|....|....|....|
NOV7a               ------------------------------------------------------------   553
NOV7b               ------------------------------------------------------------   493
gi|9938002|ref|     ------------------------------------------------------------   557
gi|4826816|ref|     ------------------------------------------------------------   557
gi|15722102|emb     ------------------------------------------------------------   461
gi|15620891|dbj     ------------------------------------------------------------   542
gi|4590406|gb|A     NWQIRNLTSFKGCMKEVWINHKLVDFGNAQRQQKITPGCALLEGEQQEEDDEQDFMDET  1370

1390       1400       1410       1420       1430       1440
                    ....|....|....|....|....|....|....|....|....|....|....|....|
NOV7a               ------------------------------------------------------------   553
NOV7b               ------------------------------------------------------------   493
gi|9938002|ref|     ------------------------------------------------------------   557
gi|4826816|ref|     ------------------------------------------------------------   557
gi|15722102|emb     ------------------------------------------------------------   461
gi|15620891|dbj     ------------------------------------------------------------   542
gi|4590406|gb|A     PHIKEEPVDPCLENKCRRGSRCVPNSNARDGYQCKCKHGQRGRYCDQGEGSTEPPTVTAA  1430

1450       1460       1470       1480       1490       1500
                    ....|....|....|....|....|....|....|....|....|....|....|....|
NOV7a               ------------------------------------------------------------   553
NOV7b               ------------------------------------------------------------   493
gi|9938002|ref|     ------------------------------------------------------------   557
gi|4826816|ref|     ------------------------------------------------------------   557
gi|15722102|emb     ------------------------------------------------------------   461
gi|15620891|dbj     ------------------------------------------------------------   542
gi|4590406|gb|A     STCRKEQVERYYTENDCRSRQPLKYAKCVGGCGNQCCAAKIVRRRKVRMVCSNNRKYIKN  1490

1510
                    ....|....|....
NOV7a               --------------   553
NOV7b               --------------   493
gi|9938002|ref|     --------------   557
gi|4826816|ref|     --------------   557
gi|15722102|emb     --------------   461
gi|15620891|dbj     --------------   542
gi|4590406|gb|A     LDIVRKCGCTKKCY  1504
```

Tables 7E–G list the domain description from DOMAIN analysis results against NOV7. This indicates that the NOV7 sequence has properties similar to those of other proteins known to contain this domain.

TABLE 7E

Domain Analysis of NOV7 gnl|Smart|smart00082, LRRCT, Leucine rich repeat C-terminal domain (SEQ ID NO:99)
CD-Length = 51 residues, 100.0% aligned
Score = 46.6 bits (109), Expect = 3e-06

```
Query:  173 NPFQCDCRVLWLLQWMPTVNASVGTGA--CAGPASLSHMQLHHLDPKTFKCT  222
            |||  ||| + |||+|+           || |  ||    |   | +|||
Sbjct:    1 NPFICDCELRWLLRWLQANRHLQDPVDLRCASPESL-RGPLLLLLPSSFKCP   51
```

TABLE 7F

Domain Analysis of NOV7

```
gnl|Pfam|pfam01463, LRRCT, Leucine rich repeat C-terminal domain.
Leucine Rich Repeats pfam00560 are short sequence motifs present in
a number of proteins with diverse functions and cellular locations.
Leucine Rich Repeats are often flanked by cysteine rich domains. This
domain is often found at the C-terminus of tandem leucine rich
repeats (SEQ ID NO:100)
CD-Length = 51 residues, 98.0% aligned
Score = 45.4 bits (106), Expect = 7e-06

Query:   173 NPFQCDCRVLWLLQWMPTVNASVGTGA--CAGPASLSEMQLHHLDPKTFKC    221
             ||| ||| + |||+|+           || | ||   |  | |   | |
Sbjct:     1 NPFICDCELRWLLRWLREPRRLEDPEDLRCASPESL-RGPLLELLPSDFSC     50
```

TABLE 7G

Domain Analysis of NOV7

```
gnl|Smart|smart00369, LRR_TYP, Leucine-rich
repeats,
typical (most populated) subfamily (SEQ ID NO:101)
CD-Length = 24 residues, 100.0% aligned
Score = 35.8 bits (81), Expect = 0.006

Query:   138    LRSLTHLSLANNHLETLPRFLFRG    161
                | +|   | |+|| | +||   |+|
Sbjct:     1    LPNLRELDLSNNQLSSLPPGAFQG     24
```

Loss of heterozygosity for 10q23-26 is seen in over 80% of glioblastoma multiforme tumors. A novel gene, LGI1 (Leucine-rich gene-Glioma Inactivated), is rearranged as a result of the t(10;19)(q24;q13) balanced translocation in the T98G glioblastoma cell line lacking any normal chromosome 10. Rearrangement of the LGI1 gene was also detected in the A172 glioblastoma cell line and several glioblastoma tumors. These rearrangements lead to a complete absence of LGI1 expression in glioblastoma cells. The LGI1 gene encodes a protein with a calculated molecular mass of 60 kD and contains 3.5 leucine-rich repeats (LRR) with conserved flanking sequences. In the LRR domain, LGI1 has the highest homology with a number of transmembrane and extracellular proteins which function as receptors and adhesion proteins. LGI1 is predominantly expressed in neural tissues, especially in brain; its expression is reduced in low grade brain tumors and it is significantly reduced or absent in malignant gliomas. Its localization to the 10q24 region, and rearrangements or inactivation in malignant brain tumors, suggest that LGI1 is a candidate tumor suppressor gene involved in progression of glial tumors.

The disclosed NOV7 nucleic acid of the invention encoding a Leucine-Rich Glioma-Inactivated Protein-like protein includes the nucleic acid whose sequence is provided in Table 7A, 7C or a fragment thereof. The invention also includes a mutant or variant nucleic acid any of whose bases may be changed from the corresponding base shown in Table 7A or 7C while still encoding a protein that maintains its Leucine-Rich Glioma-Inactivated Protein-like activities and physiological functions; or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 40 percent of the bases may be so changed.

The disclosed NOV7 protein of the invention includes the Leucine-Rich Glioma-Inactivated Protein-like protein whose sequence is provided in Table 7B or 7D. The invention also includes a mutant or variant protein any of whose residues may be changed from the corresponding residue shown in Table 7B or 7D while still encoding a protein that maintains its Leucine-Rich Glioma-Inactivated Protein-like activities and physiological functions, or a functional fragment thereof. In the mutant or variant protein, up to about 69 percent of the residues may be so changed.

The protein similarity information, expression pattern, and map location for the Leucine-Rich Glioma-inactivated Protein-like protein and nucleic acid (NOV7) disclosed herein suggest that NOV7 may have important structural and/or physiological functions characteristic of the Leucine-Rich Glioma-Inactivated Protein-like family. Therefore, the NOV7 nucleic acids and proteins of the invention are useful in potential diagnostic and therapeutic applications. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo.

The NOV7 nucleic acids and proteins of the invention are useful in potential diagnostic and therapeutic applications implicated in various diseases and disorders described below and/or other pathologies. For example, the compositions of the present invention will have efficacy for treatment of patients suffering from cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, anemia, bleeding disorders, sclerodermna, diabetes, Von Hippel-Lindau (VHL) syndrome, pancreatitis, obesity, fertility, cirrhosis, inflammatory bowel disease, diverticular disease, hemophilia, hypercoagulation, idiopathic thrombocytopenic purpura, immunodeficiencics, graft versus host disease, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, multiple sclerosis, leukodystrophies, neuroprotection, systemic lupus erythematosus, autoimmune disease, asthma, emphysema, scleroderma, allergy, ARDS, autoimmune disease, renal artery stenosis, interstitial nephritis, glomerulonephritis, polycystic kidney disease, systemic lupus erythematosus, renal tubular acidosis, IgA nephropathy Cholesteryl ester storage disease; Corneal dystrophy, Thiel-Behnke type; Dubin-Johnson syndrome; Leukemia, T-cell acute lymphocytic; Retinol binding protein, deficiency of; SEMD, Pakistani type; Spinocerebellar ataxia, infantile-onset, with sensory neuropathy; Split hand/foot malformation, type 3; Tolbutamide poor metabolizer; Urofacial syndrome; Warfarin sensitivity; Wolman disease, and/or other pathologies/disorders. The NOV7 nucleic acid, or fragments thereof, may further be useful in diagnostic applications, wherein the presence or amount of the nucleic acid or the protein are to be assessed.

NOV7 nucleic acids and polypeptides are further useful in the generation of antibodies that bind immunospecifically to the novel substances of the invention for use in therapeutic or diagnostic methods. These antibodies may be generated according to methods known in the art, using prediction from hydrophobicity charts, as described in the "Anti-NOVX Antibodies" section below. For example the disclosed NOV7 protein have multiple hydrophilic regions, each of which can be used as an immunogen. This novel protein also has value in development of powerful assay system for functional analysis of various human disorders, which will help in understanding of pathology of the disease and development of new drug targets for various disorders.

NOV8

A disclosed NOV8 nucleic acid of 430 nucleotides (also referred to as AL163195_dal) encoding a novel RNase-like protein is shown in Table 8A. An open reading frame was identified beginning with an ATG initiation codon at nucleotides 16–18 and ending with a TAA codon at nucleotides 408410. A putative untranslated region upstream from the initiation codon is underlined in Table 8A. The start and stop codons are in bold letters.

TABLE 8A

NOV8 nucleotide sequence (SEQ ID NO:31).

GGGGAATTCGCCCTTATGATATGTCTTCCACATTACTGACATTCAGAAGTTTACATTATAATGACCCCAAGG

GAAACAGTTCGGGTAATGACAAAGAGTGTTGCAATGACATGACAGTCTGGAGAAAAGTTTCAGAAGCAAACG

GATCGTGCAAGTGGAGCAATAACTTCATCCGCAGCTCCACAGAAGTGATGCGCAGGGTCCACAGGGCCCCCA

GCTGCAAGTTTGTACAGAATCCTGGCATAAGCTGCTGTGAGAGCCTAGAACTGGAAAATACAGTGTGCCAGT

TCACTACAGGCAAACAATTCCCCAGGTGCCAATACCATAGTGTTACCTCATTAGAGAAGATATTGACAGTGC

TGACAGGTCATTCTCTGATGAGCTGGTTAGTTTGTGGCTCTAAGTTGTAAATCCCACAGAGCTTTAGGAC

The NOV8 nucleic acid sequence is located on chromsome 14.

The disclosed NOV8 polypeptide (SEQ ID NO:32) encoded by SEQ ID NO:31 has 129 amino acid residues and is presented in Table 8B using the one-letter amino acid code. Signal P, Psort and/or Hydropathy results predict that NOV8 has a signal peptide and is likely to be localized to the microbody (peroxisome) with a certainty of 0.8000. In other embodiments, NOV8 may also be localized to the mitochondrial matrix space with a certainty of 0.1000, or the lysosome (lumen) with a certainty of 0.1000.

TABLE 8B

Encoded NOV8 protein sequence (SEQ ID NO:32).

MSSTLLTFRSLNYNDPKGNSSGNDKECCNDMTWRKVSEANGSCKWSNNFIRSSTEVMRRVHRAPSCKFVQN

PGISCCESLELENTVCQFTTGKQFPRCQYHSVTSLEKILTVLTGHSLMSWLVCGSKL

A search of sequence databases reveals that the NOV5 amino acid sequence has 35 of 115 amino acid residues (30%) identical to, and 56 of 115 amino acid residues (48%) similar to, the 124 amino acid residue Ribonuclease Pancreatic (EC 3.1.27.5) (RNASE I) (RNASE A) protein from *Balaenoptera acutorostrata* (Minke whale) (Lesser rorqual) (SWISSPROT-ACC:P00673) (E=1.2e$^{-7}$).

NOV8 also has homology to the amino acid sequence shown in the BLASTP data listed in Table 8C.

respectively. The assignment to mouse 14 and the close linkage to the other 2 loci was confirmed by study of one of Snell's congenic strains: the 3 loci went together. Elliott et al. (Cytogenet. Cell Genet. 42: 110–112, 1986) predicted that the homologous human gene RIBI is on chromosome 14.

Human pancreatic RNase is monomeric and is devoid of any biologic activity other than its RNA degrading ability. Piccoli et al. (Proc. Nat. Acad. Sci. 96: 7768–7773, 1999) engineered the monomeric form into a dimeric protein with

TABLE 8C

BLAST results for NOV8

| Gene Index/ Identifier | Protein/Organism | Length (aa) | Identity (%) | Positives (%) | Expect |
|---|---|---|---|---|---|
| gi\|17476497\|ref\|XP_058653.1\| (XM_058653) | similar to RIBONUCLEASE PANCREATIC (RNASE 1) (RNASE A) | 199 | 129/129 (100%) | 129/129 (100%) | 5e-67 |
| >gi\|133196\|sp\|P00673\| RNP_BALAC | RIBONUCLEASE PANCREATIC (RNASE 1) (RNASE A) | 124 | 33/116 (28%) | 55/116 (46%), | 0.006 |

The homology of these sequences is shown graphically in the ClustalW analysis shown in Table 8D.

cytotoxic action on mouse and human tumor cells, but lacking any appreciable toxicity on human and mouse

TABLE 8D

Information for the ClustalW proteins

```
1) Nove8 (SEQ ID NO:32)
2) gi|17476497|ref|XP_058653.1| (XM_058653) similar to RIBONUCLEASE PANCREATIC
(RNASE 1) (RNASE A) (SEQ ID NO:102)
3) gi|133196|sp|P00673|RNP_BALAC RIBONUCLEASE PANCREATIC (RNASE 1) (RNASE A)
(SEQ ID NO:103)

10        20        30        40        50        60
                 ....|....|....|....|....|....|....|....|....|....|....|....|
NOV8             ------------------------------------------------------------   1
gi|17476497|ref  METFPLLLLSLGLVLAEASESTMKIIKEEFTDEEMQYDMAKSGQEKQTIEILMNPILLVK   60
gi|133196|sp|p0  ------------------------------------------------------------   1

70        80        90       100       110       120
                 ....|....|....|....|....|....|....|....|....|....|....|....|
NOV8             ----------MSSTLLTFRSLHYNDPKGNSSGNDKECCNDMTVWRKVSEANGSCKWSNNF   50
gi|17476497|ref  NTSLSMSKDDMSSTLLTFRSLHYNDPKGNSSGNDKECCMDMTVWRKVSEANGSCKWSNNF  120
gi|133196|sp|p0  ----------RESPAMKFQRQHMDS--GNSPGNNPNYCNQMMMRRKMTTG--RCKPVKTF   46

130       140       150       160       170       180
                 ....|....|....|....|....|....|....|....|....|....|....|....|
NOV8             IRSSTEVMRRVHRAPSCKFVQNPGISCCES-LELENTVCQFTTGKQFPRCQYHSVTSLEK  109
gi|17476497|ref  IRSSTEVMRRVHRAPSCKFVQNPGISCCES-LELENTVCQFTTGKQFPRCQYHSVTSLEK  179
gi|133196|sp|p0  VHESIDDNKKAVCSQ-KNVLCKNGRTNCYESNSRMHITDCRQTGSSKYPNCAYKTSQKEKH  105

190       200
                 ....|....|....|....|
NOV8             ILTVLTGHSLMSWLVCGSKL                                          129
gi|17476497|ref  ILTVLTGHSLMSWLVCGSKL                                          199
gi|133196|sp|p0  IKVACEGNPYVPVHFDNSV-                                          124
```

Pancreatic ribonuclease (EC 3.1.27.5) is one of the digestive enzymes secreted in abundance by the pancreas. Elliott et al. (Cytogenet. Cell Genet. 42: 110–112, 1986) mapped the mouse gene to chromosome 14 by Southern blot analysis of genomic DNA from recombinant inbred strains of mice, using a probe isolated from a pancreatic cDNA library with the rat cDNA. A polymorphic BamHI site was used to demonstrate complete concordance of the Rib-1 locus with Tcra and Np-2, encoding the alpha subunit of the T-cell receptor (186880) and nucleoside phosphorylase (164050), normal cells. The dimeric variant of human pancreatic RNase selectively sensitized cells derived from a human thyroid tumor to apoptotic death. Because of its selectivity for tumor cells, and because of its human origin, this protein was thought to represent an attractive tool for anticancer therapy.

The disclosed NOV8 nucleic acid of the invention encoding a RNase-like protein includes the nucleic acid whose sequence is provided in Table 8A, or a fragment thereof. The invention also includes a mutant or variant nucleic acid any of whose bases may be changed from the corresponding base shown in Table 8A while still encoding a protein that maintains its RNase-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 10% percent of the bases may be so changed.

The disclosed NOV8 protein of the invention includes the RNase-like protein whose sequence is provided in Table 8B. The invention also includes a mutant or variant protein any of whose residues may be changed from the corresponding residue shown in Table 2 while still encoding a protein that maintains its RNase-like activities and physiological functions, or a functional fragment thereof. In the mutant or variant protein, up to about 72 percent of the residues may be so changed.

The invention further encompasses antibodies and antibody fragments, such as $F_{ab}$ or $F_{ab})_2$, that bind immuno-specifically to any of the proteins of the invention.

The above defined information for this invention suggests that this RNase-like protein (NOV8) may function as a member of a "RNase family". Therefore, the NOV8 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV8 nucleic acids and proteins of the invention are useful in potential therapeutic applications implicated in Diabetes, Von Hippel-Lindau (VHL) syndrome, Pancreatitis, Obesity, Hyperthyroidism and Hypothyroidism and Cancers including, but no limited to Thyroid and Pancreas, and/or other diseases or pathologies.

NOV8 nucleic acids and polypeptides are further useful in the generation of antibodies that bind immuno-specifically to the novel NOV8 substances for use in therapeutic or diagnostic methods. These antibodies may be generated according to methods known in the art, using prediction from hydrophobicity charts, as described in the "Anti-NOVX Antibodies" section below. The disclosed NOV8 protein has multiple hydrophilic regions, each of which can be used as an immunogen. These novel proteins can be used in assay systems for functional analysis of various human disorders, which will help in understanding of pathology of the disease and development of new drug targets for various disorders.

NOV9

A disclosed NOV9 nucleic acid of 1860 nucleotides (also referred to as CGS6069-01) encoding a novel Insulin like growth factor binding protein-like protein is shown in Table 9A. An open reading frame was identified beginning with an ATG initiation codon at nucleotides 1–3 and ending with a TGA codon at nucleotides 1858–1860. The start and stop codons are in bold letters in Table 9A.

TABLE 9A

NOV9 nucleotide sequence (SEQ ID NO:33).

ATGGACAGGCACTTGCTGTTGCCTGGTCTGCTCCTGTCCCTTCCTCTGACCGCAGGCTGGACCATCTCCAAT

AGTTTAGTGACTGAAGGCTCCCGGCTGTCTATGGTCTCCCGCTTCTTCCTGATTTGCCTCTTGGACTCCAGC

CTGCCTTTCCTCACCACATGCCTCTCAGTGATCAACTTGGTGCGGGCCTTGGAAACTGTGCTGCAGAACGTG

GAGGGTCTCTGTCAATCTGGTTCCACTTCTGCTCTGCCTCAGGATGCCTTCTCCCGCTTTCCTGGGCTCAAG

GCTGAAGCTGGCCAGTCCTGGAGCCTTCCAGGTCCTCAAGCTGGGGACTCTGAATCTGGACCACACAAAGAT

GAAGGCAGATGCACTGGTGGGACGGGGCTGCAGAGATTGGATGCCCTGTGACACTCACTGACATGGCTGAG

CTGCCTGCCAGGATGGTTGCCCATTTTGAGCTTCAGGAGCTGAATTTGGGGATTAATCGGACAAGGCACATA

GCCCTGGAAGGCCTGGCTTCCTGTCACAGCCTGAAGAGCTCGGGTCTTCGGAGCAATGGCCTGATTGAGTTA

CCACGAGGTTTCCTGGCTGCCATGCCCAGGCTTCAGAGACTGAACCTGGCCAACAACCAACTGAGGAGCGCC

ATGTTGTGTATGAATGAGACAGGGTTTGTGTCAGGATTGTGGGCCCTGGATCTGTCCAAGAATAGGCTGTGT

ACCCTGTCCCCAGTCATCTTCTCCTGTTTGCCCCACCTGCGGGAGCTGCTACTTCAAGGGAACCAACTGGTT

TGCTTGAAAGACCAGGTATTCCAGGGCCTACAGAGGCTACAGACCTTGAACTTGGGCAATAATCCACTGGTA

ACCCTGGGTGAGGGCTGGCTGGCTCCTCTGCCTACACTGACCACCCAAAACCTGGTAGGTACTCACATGGTG

CTGAGCCCAACCTGGGGCTTCCGGGGCCCAGAAAGTCTGCACAGCTTGAGAATACAGTTTCCCTTTGGCCCT

TABLE 9A-continued

NOV9 nucleotide sequence (SEQ ID NO:33).

GCGGGAGTAGCATTTTCCCTGCTCACAAGACTGACTAGCTTGGAGCTCCACGCAGTTTCAGGCATGAAGCAT

TGGAGGTTGTCTCCTAATGTCTTTCCAGTCTTGCAGATCCTGACTTTAAAGGGCTGGGGACTGCAGCTAGAG

ACCCAGAATATCTCCAAGATCTTCCCTGCCCTTCATCAACTCTCCCTGCTTGGCACTCCCGAAGCTCAAGTC

CTTGAAGGATGGGGAAACAGGCATAGCCCTAGGCCCTACTGCATCACGGGACTGCCCAGTCTACAGGAGCTG

AAGCTGCAGGCACTGCAGTCTCAAGCATGCCCCTGCCCAGTGCGGCTTGAGGAGCTGGTGGGGTTGGAGACA

CTGTCTGCTGCTGCTTTTGGGGGCCTCGGCAGTCTCCAGGTCTTAGTACTAGACAGGGAGAAAGACTTCATG

CTGGATGACAGCCTCCAGGAGCACAGTCCTCGGATGCCCCAGTACATCTATATTCTGACCTCATCCTTGGCC

TGCCAGTGTGCCAATGCCTGCCTCTGCCCTGCTGCTTCTGCTGGTCTCCTTGCCCTTCCTAAAGGAAGCCAG

GAATTCCTGGATCCTCTAACTCAAGGCCTTGCTCAGGGTTTGGTTCCAGAGTCTGAGGAGTCAGAAGGGCAA

GACCAGGGCTGGATGGTGCAGGAGCTGCTGCCTGCTCTAGAGGACTGCCCTCCAGCTGGCCGGGGCTGCCA

CTCTGCCTCCATGAGTGGGATTTTGAGCCAGGCAAGGATGTGGCTGACAATGCAGCAGACAGCATGATTGGC

CTGGTTGCTCCGCTGAAGAGACTATTGCATGTGGCCCAAGGAAGAGGAAAGAAAGAATGA

The disclosed NOV9 nucleic acid sequence, localized to the q12 region of chromosome 1, has 410 of 699 bases (58%) identical to a gb:GENBANK-ID:MMU91967|acc:U91967.1 mRNA from Mus musculus (Mus musculus platelet glycoprotein 1b-alpha gene, complete cds) (E=0.031).

The disclosed NOV9 polypeptide (SEQ ID NO:34) encoded by SEQ ID NO:33 has 619 amino acid residues is presented in Table 9B using the one-letter amino acid code. Signal P, Psort and/or Hydropathy results predict that NOV9 has a signal peptide and is likely to be localized in the lysosome (lumen) with a certainty of 0.6400. In other embodiments, NOV9 is predicted to be localized extracellularly with a certainty of 0.5087, to the endoplasmic reticulum (membrane) with a certainty of 0.1000, or to the endoplasmic reticulum (lumen) with a certainty of 0.1000. The most likely ceavage site for NOV9 is between positions 19 and TAG-WT.

ptnr:SWISSNEW-ACC:002833 protein from Papio hamadryas (Hamadryas baboon) (Insulin-Like Growth Factor Binding Protein Complex Acid Labile Chain Precursor (ALS)) (E=1.1e$^{-9}$)

NOV9 is expressed in at least brain and liver. This information was derived by determining the tissue sources of the sequences that were included in the invention including but not limited to SeqCalling sources, Public EST sources, Literature sources, and/or RACE sources.

In addition, the sequence is predicted to be expressed in B-cells and blood cells because of the expression pattern of (GENBANK-ID: gb:GENBANK-ID:MMU91967|acc:U91967.1) a closely related Mus musculus platelet glycoprotein 1b-alpha gene, complete cds homolog.

TABLE 9B

Encoded NOV9 protein sequence (SEQ ID NO:34).

MDRHLLLPGLLLSLPLTAGWTISNSLVTEGSRLSMVSRFFLICLLDSSLPFLTTCLSVINLVRALETVLQNV

EGLCQSGSTSALPQDAFSRFPGLKAEAGQSWSLPGPQAGDSESGPHKDEGRCTGGTGAAEIGCPVTLTDMAE

LPARMVAHFELQELNLGINRTRHIALEGLASCHSLKSSGLRSNGLIELPRGFLAAMPRLQRLNLANNQLRSA

MLCMNETGFVSGLWALDLSKNRLCTLSPVIFSCLPHLRELLLQGNQLVCLKDQVFQGLQRLQTLNLGNNPLV

TLGEGWLAPLPTLTTQNLVGTHMVLSPTWGFRGPESLHSLRIQFPFGPAGVAFSLLTRLTSLELHAVSGMKH

WRLSPNVFPVLQILTLKGWGLQLETQNISKIFPALHQLSLLGTPEAQVLEGWGNRHSPRPYCITGLPSLQEL

KLQALQSQACPCPVRLEELVGLETLSAAAFGGLGSLQVLVLDREKDFMLDDSLQEHSPRMPQYIYILTSSLA

CQCANACLCPAASAGLLALPKGSQEFLDPLTQGLAQGLVPESEESEGQDQGWMVQELLPALEDCPPAGRGLP

LCLHEWDFEPGKDVADNAADSMIGLVAPLKRLLHVAQGRGKKE

A BLASTX of NOV9 shows that it has 77 of 253 amino acid residues (30%) identical to, and 114 of 253 amino acid residues (45%) similar to, the 605 amino acid residue The disclosed NOV9 polypeptide has homology to the amino acid sequences shown in the BLASTP data listed in Table 9C.

TABLE 9C

BLAST results for NOV9

| Gene Index/ Identifier | Protein/Organism | Length (aa) | Identity (%) | Positives (%) | Expect |
|---|---|---|---|---|---|
| gi\|5669800\|gb\|AAD46477.1\| AF113614_1 (AF113614) | Toll-like receptor 2 [Cricetulus griseus] | 503 | 41/138 (29%) | 71/138 (50%) | 2e-07 |
| gi\|6449037\|gb\|AAF08787.1\| (AF163101) | platelet glycoprotein V [Mus musculus] | 567 | 63/206 (30%) | 84/206 (40%) | 4e-07 |
| gi\|6680055\|ref\|NP_032174.1\| (NM_008148) | glycoprotein V (platelet); GP V [Mus musculus] | 567 | 63/206 (30%) | 84/206 (40%) | 6e-07 |
| gi\|6678754\|ref\|NP_032559.1\| (NM_008533) | lymphocyte antigen 78 [Mus musculus] | 661 | 72/269 (26%) | 112/269 (40%) | 1e-06 |
| gi\|112908\|sp\|P02750\| A2GL_HUMAN | LEUCINE-RICH ALPHA-2- GLYCOPROTEIN (LRG) | 312 | 60/196 (30%) | 82/196 (41%) | 2e-06 |

The homology between these and other sequences is shown graphically in the ClustalW analysis shown in Table 9D. In the ClustalW alignment of the NOV9 protein, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 9D

ClustalW Analysis of NOV9

1) Novel NOV9 (SEQ ID NO:34)
2) gi|5669800|gb|AAD46477.1|AP113614_1 (AF113614) Toll-like receptor 2 [Cricetulus griseus] (SEQ ID NO:104)
3) gi|6449037|gb|AAF08787.1| (AF163101) platelet glycoprotein V [Mus musculus] (SEQ ID NO:105)
4) gi|6680055|ref|NP_032174.1| (NM_008148) glycoprotein V (platelet); GP V [Mus musculus] (SEQ ID NO:106)
5) gi|6678754|ref|NP_032559.1| (NM_008533) lymphocyte antigen 78 [Mus musculus] (SEQ ID NO:107)
6) gi|112908|sp|P02750|A2GL_HUMAN LEUCINE-RICH ALPHA-2-GLYCOPROTEIN (LRG) (SEQ ID NO:108)

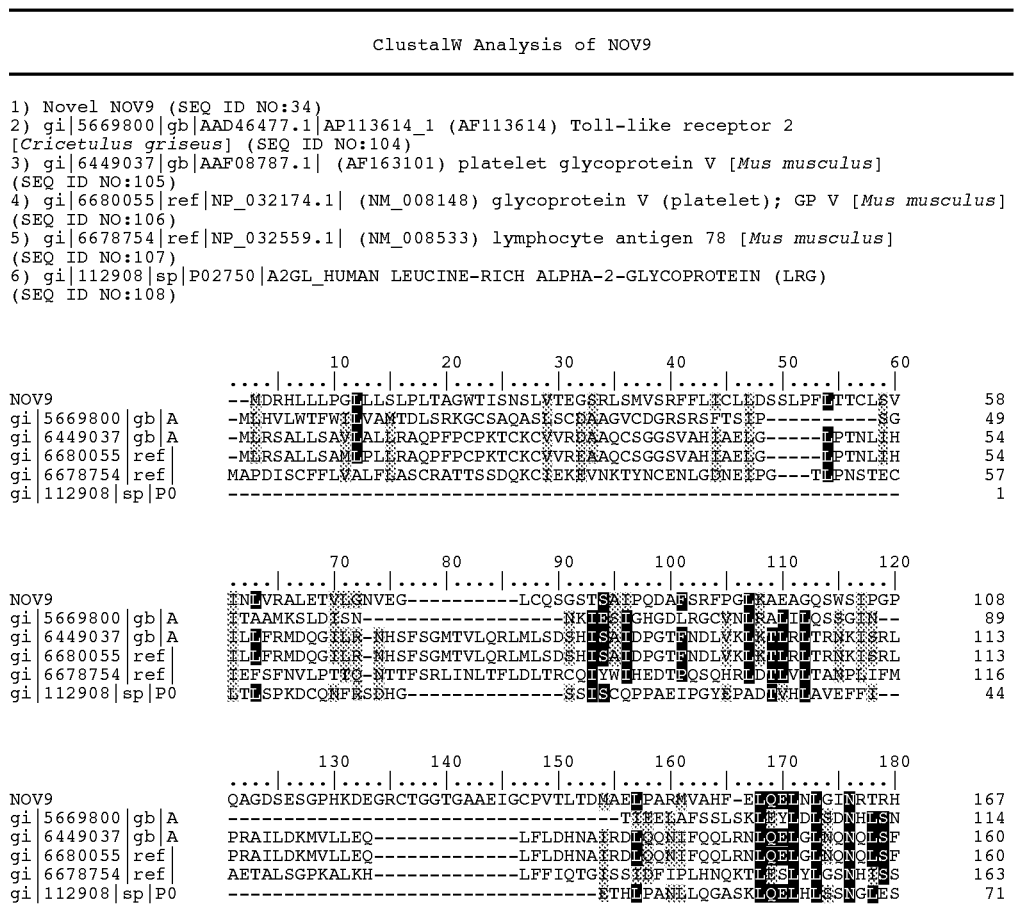

TABLE 9D-continued

ClustalW Analysis of NOV9

```
                         190       200       210       220       230       240
                    ....|....|....|....|....|....|....|....|....|....|....|....|
NOV9                YALEGLASCHSLKSSGTRSNGLIELPNQ-FSAAMPNLQRLNLANNQ---------------    212
gi|5669800|gb|A     TSSSWFRPLSSLKYLNLLGNPYRILGETPLFLNLTHLQTLRVGNVAT---------------    161
gi|6449037|gb|A     LPANLFSSLRELKLLDLSRNNLTHLPKG-LSGAQVKLEKLLLYENQ---------------    205
gi|6680055|ref|     LPANLFSSLRELKLLDLSRNNLTHLPKG-LSGAQVKLEKLLLYENQ---------------    205
gi|6678754|ref|     IKLPKGFPTEKLKVLDFQNNAIHYLSKE-DMSSLQQATNLSLNLGNDIAGIEPGAFDSA    222
gi|112908|sp|P0     LSPEFLRPVPQLRVLDITRNALTGLPPG-LFQASATLDTLVLKENQ---------------    116

250       260       270       280       290       300
                    ....|....|....|....|....|....|....|....|....|....|....|....|
NOV9                ---------------LRSAMLCMNETGFYSGLWALD-------------------LS    235
gi|5669800|gb|A     ---------------FSGLRRTDFAG--LTSLDLL-------------------IX    182
gi|6449037|gb|A     ---------------LTSVDSGLLSN--LGALTPLR-------------------LS    226
gi|6680055|ref|     ---------------LTSVDSGLLSN--LGALTPLR-------------------LS    226
gi|6678754|ref|     VFQSLNFGGTQNLLVIFKGLKNSTIQSLWLGTFEDMSDEDISPAVFEGLCEMSVESINLQ    282
gi|112908|sp|P0     ---------------LEVLEVSWKHG--LKALGHLK-------------------LS    137

310       320       330       340       350       360
                    ....|....|....|....|....|....|....|....|....|....|....|....|
NOV9                NNRLCTESPVIFSCLPHLRELLLQGNQLVCLKDQVFQGLQRLQTLNLGNNPLVTLGEGWL    295
gi|5669800|gb|A     ALSLQNYEPCSLQSLQSLHHLTFHLSQSDPLLGVFEDTLSSVGYLELRDANLESFYFSEL    242
gi|6449037|gb|A     RNHLRSVAPCAFDRLGNLSSITLSGNLLESLPPALFLHVSSVSRLTLFENPLEELPDVLF    286
gi|6680055|ref|     RNHLRSVAPCAFDRLGNLSSITLSGNLLESLPPALFLHVSSVSRLTLFENPLEELPDVLF    286
gi|6678754|ref|     KHYFFNLSSNTEHCFSGLQELDLTATHLSELPSGLVG-LSTLKKLVLSANKFENLCQISA    341
gi|112908|sp|P0     GNRLRKLPPGLLANFTLLRTLDLGENQLETLPPDLLRGPLQLERLHLEGNKLQVLGKDLL    197

370       380       390       400       410       420
                    ....|....|....|....|....|....|....|....|....|....|....|....|
NOV9                APLPT---LTTQNLVGTHMVLSP-TWGFRGPESLHSLRLQFP-FGPAGVAFSLLTRLTSL    350
gi|5669800|gb|A     STDEMNSPMKKLAFQNADLTDES-------FNELLKLLRYTPELLEVEFDDCTLNGVGDF    295
gi|6449037|gb|A     GEMAG---LRELWLNGTHLSTLP-AAAAFRNLSGLQTLGLTRN-PRLSALPRGVFQGLREL    341
gi|6680055|ref|     GEMAG---LRELWLNGTHLSTLP-AAAAFRNLSGLQTLGLTRN-PRLSALPRGVFQGLREL    341
gi|6678754|ref|     SNFPS---LTHLSLKGNTKRLELGTGCLENLENLRELDLSHDDIETSDCCNLQLRNLSHL    398
gi|112908|sp|P0     LPQPD---LRYLFLNGN-------------------KLAR-------VAAGAFQGLRQL    227

430       440       450       460       470       480
                    ....|....|....|....|....|....|....|....|....|....|....|....|
NOV9                RLHAVSGMKHWRLSPNVFPVLQILTLKGWGLQLE-TQNISKIFFPALHQLSLLGTPEAQVL    409
gi|5669800|gb|A     QPSESD-------VVRELGKVETLIIRRLHIPR----------------------    321
gi|6449037|gb|A     RVLALH--------TNALAERDDALSGLGHLRQ-VSLRHNRLRALPRTLFR--------    384
gi|6680055|ref|     RVLALH--------TNALAERDDALSGLGHLRQ-VSLRHNRLRALPRTLFR--------    384
gi|6678754|ref|     QSLNLSYNEPLSLKTEAFKECPQLELLDLAFTRLKVKDAQSPFQNLHLLKVLN-------    451
gi|112908|sp|P0     DVLDLS--------NNSLASVPEGLWASLGQP---------------------------    251

490       500       510       520       530       540
                    ....|....|....|....|....|....|....|....|....|....|....|....|
NOV9                EGWGNRHSPRPYCITGLPSLQELKLQALQSQACPCPVRLEELVGLETLSAAAFGGLGSLQ    469
gi|5669800|gb|A     ---------------FYSFYDLS-----------------------TVYTLLEKVK    339
gi|6449037|gb|A     ---------------NLSSLESVQLEHNQ---------------LETLPGDVFAALPGLT    414
gi|6680055|ref|     ---------------NLSSLESVQLEHNQ---------------LETLPGDVFAALPGLT    414
gi|6678754|ref|     LSHSLLDISSEQLFDGLPALQHLNLQGNHFPK------------GNIQKTNSLQTLGRLE    499
gi|112908|sp|P0     ---------------NWDMRDGFDKS---------------------G--------    263

550       560       570       580       590       600
                    ....|....|....|....|....|....|....|....|....|....|....|....|
NOV9                VEVLDREKDKMLDDSLQEHSPRMP----QHIYITTSSLAQQCANACLCPAASAGLLALPK    525
gi|5669800|gb|A     RITVENSKVIEVPCLFSQHLSLEFLD-LSENLMVEEYLKNAACECSWPSLQTLLIRQNK    398
gi|6449037|gb|A     QVELGH-NPWLCDCGLWPFLQWLR----HHPDILGRDEPPQCR--GPEPRASLSFWELLQ    467
gi|6680055|ref|     QVELGH-NPWLCDCGLWPFLQWLR----HHPDILGRDEPPQCR--GPEPRASLSFWELLQ    467
gi|6678754|ref|     IGVLSFCDLSSIDQHAFTSLKMMNHVDLSNNRLTSSSIEALSHLKGIYLNLASNHISIIL    559
gi|112908|sp|P0     -------NPWLCDQNLSDLYRWLQ----AQKEKMFSQNDTRCA--GPEAVKGQTLLAMAK    310

610       620       630       640       650       660
                    ....|....|....|....|....|....|....|....|....|....|....|....|
NOV9                GSQEFLDPLTQGLAQG--LVPESEESEGQDQ----GWMVQELLPADEDCPPAGRG--LPL    577
gi|5669800|gb|A     LKSIERTG-KILLTLKNLTALKISRNLSFQSMPDSCQWPGKMRFLNLSSTGIQAVKMCLPQ    457
gi|6449037|gb|A     GDPWCPDPRSLPLDPPTENALEAPVPSWLPN----SWQSLTWAQLVARGESPNNR--LYW    521
gi|6680055|ref|     GDPWCPDPRSLPLDPPTENALEAPVPSWLPN----SWQSLTWAQLVARGESPNNR--LYW    521
gi|6678754|ref|     PSLLPILSQQRTLNLR-QNPLDCTCSNIYFL----EWYKSNMQKLEDTEDTLCENPPLLR    614
gi|112908|sp|P0     SQ---------------------------------------------------------    312

670       680       690       700
                    ....|....|....|....|....|....|....|....|..|
NOV9                CLHEWDFEPGKDVADNAADSMIGLVAPLKRLLHVAQGRGKKE-----    619
gi|5669800|gb|A     TLEVLDVSNNNLISFSLFLPLERELYISRNKLHTLPMPPCSLCYWS-    503
gi|6449037|gb|A     GLYILLDVAQAILAAFIVFAMIKIGQLFRTLIREKLLLEAMGKSCN-    567
gi|6680055|ref|     GLYILLDVAQAILAAFIVFAMIKIGQLFRTLIREKLLLEAMGKSCN-    567
gi|6678754|ref|     GVRLSDVTLSCSMAAVGIFFLIVFLLVFAILLIFAVKYFLRWKYQHI    661
gi|112908|sp|P0     ---------------------------------------------    312
```

Table 9E lists the domain description from DOMAIN analysis results against NOV9. This indicates that the NOV9 sequence has properties similar to those of other proteins known to contain this domain.

TABLE 9E

Domain Analysis of NOV9

```
gnl|Pfam|pfam01582, TIR, TIR domain. The TIR domain is an
intracellular signaling domain found in MyD88, interleukin 1
receptor and the Toll receptor. Called TIR (by SMART?) for
Toll - Interleukin - Resistance. (SEQ ID NO:109)
CD-Length = 141 residues, 29.1% aligned
Score = 38.9 bits (89), Expect = 9e-04

Query:   549 SEGQDQGWMVQELLPALEDCPPAGRGLPLCLHEWDPEPGKDVADN  593
                 |+    |   ||   ||+      |+ | + +  |   ||+ + +|
Sbjct:     6 SGKDDRDTFVSHLLKELEE----KPGIKLFIDDRDELPGESILEN   46
```

The predicted sequence described here belongs to the leucine-rich repeat protein family. It is homologous to insulin like growth factor binding protein (IGFBP) and RP105, a novel B cell surface molecule. It contains five leucine-rich repeat domains. Leucine-rich repeats (IRRs) are relatively short motifs (22–28 residues in length) found in a variety of cytoplasmic, membrane and extracellular proteins (I). Although these proteins are associated with widely different functions, a common property involves protein—protein interaction. Other functions of LRR-containing proteins include, for example, binding to enzymes and vascular repair (I). LRRs form elongated non-globular structures and are often flanked by cysteine rich domains. The circulating insulin-like growth factors (IGF-I and -II) occur largely as components of a 140 kDa protein complex with IGF binding protein-3 and the acid-labile subunit (ALS). This ternary complex regulates the metabolic effects of the serum IGFs by limiting their access to tissue fluids. A cDNA for baboon ALS was isolated by Delhanty and Baxter (2) and used to screen Northern blots of total RNA from the lung, liver, kidney, adrenal, muscle, intestine, and spleen of adult baboons. The expression of the single approximately 2.2 kb baboon ALS mRNA transcript was restricted to the liver, suggesting that serum ALS levels are controlled by regulation of hepatic expression of this peptide in primates (2).

The RP105 Ag is a murine B cell surface molecule that transmits an activation signal into B cells or dexamethasone-induced apoptosis, and to B cell proliferation. A cDNA encoding the RP105 Ag was isolated by Miyake, et al (3). An encoded protein is a type I transmembrane protein consisting of 641 amino acids in a mature form. Northern hybridization with a probe specific for the cDNA clone detected a transcript with a size of approximately 3 kb. The transcript was observed in spleen, but not in thymus, kidney, muscle, heart, brain, or liver. Stable transfection of the cDNA clone conferred the expression of the RP105 Ag on a pro-B cell line, which was confirmed by immunofluorescence staining and immunoprecipitation with anti-RP105 mAb. The RP105 molecule possesses 22 tandem repeats of a leucine-rich motif. These repeated motifs are observed in members of the leucine-rich repeat protein family, and have been implicated in protein—protein interactions, such as cell adhesion or receptor-ligand binding. Amino- and carboxyl-flanking regions that are characteristically conserved among members of the family are located on both sides of tandemly repeated leucine-rich motifs in RP105 molecule. These results demonstrate that RP105 is a novel member of the leucine-rich repeat protein family, and the first member that is specifically expressed on B cells (3).

Because of the presence of the Leucine rich repeat domains and the homology to the IGFBP and RP105, we anticipate that the novel sequence described here will have useful properties and functions similar to these genes.

References: 1. Artavanis-Tsakonas S., Goodman C. S., Rothberg J. M., Jacobs J. R. (1990) Slit: an extracellular protein necessary for development of midline glia and commissural axon pathways contains both EGF and LRR domains. Genes Dev. 4: 2169–2187. 2. Delhanty P, Baxter RC. (1992) The cloning and expression of the baboon acid-labile subunit of the insulin-like growth factor binding protein complex. Biochem Biophys Res Commun. 227(3):897–902. 3. Miyake K, Yamashita Y, Ogata M, Sudo T, Kimoto M. (1995) RP105, a novel B cell surface molecule implicated in B cell activation, is a member of the leucine-rich repeat protein family. J Immunol. 154(7):3333–40

The disclosed NOV9 nucleic acid of the invention encoding a Insulin like growth factor binding protein-like protein includes the nucleic acid whose sequence is provided in Table 9A, or a fragment thereof. The invention also includes a mutant or variant nucleic acid any of whose bases may be changed from the corresponding base shown in Table 9A while still encoding a protein that maintains its Insulin like growth factor binding protein-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject.

The disclosed NOV9 protein of the invention includes the Insulin like growth factor binding protein-like protein whose sequence is provided in Table 9B. The invention also includes a mutant or variant protein any of whose residues may be changed from the corresponding residue shown in Table 2 while still encoding a protein that maintains its Insulin like growth factor binding protein-like activities and physiological functions, or a functional fragment thereof. In the mutant or variant protein, up to about 74 percent of the residues may be so changed.

The invention further encompasses antibodies and antibody fragments, such as $F_{ab}$ or $(Fab)_2$, that bind immunospecifically to any of the proteins of the invention.

The above defined information for this invention suggests that this Insulin like growth factor binding protein-like protein (NOV9) may function as a member of a "Insulin like growth factor binding protein family". Therefore, the NOV9 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV9 nucleic acids and proteins of the invention are useful in potential therapeutic applications implicated in diabetes, obesity, Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, cirrhosis, transplantation, hemophilia, hypercoagulation, idiopathic thrombocytopenic purpura, autoimmume disease, allergies, immunodeficiencies, graft versus host disease (GVHD), lymphaedema, and other diseases, disorders and conditions of the like.

NOV9 nucleic acids and polypeptides are further useful in the generation of antibodies that bind immuno-specifically to the novel NOV9 substances for use in therapeutic or diagnostic methods. These antibodies may be generated according to methods known in the art, using prediction from hydrophobicity charts, as described in the "Anti-NOVX Antibodies" section below. The disclosed NOV9 protein has multiple hydrophilic regions, each of which can be used as an immunogen. These novel proteins can be used in assay systems for functional analysis of various human disorders, which will help in understanding of pathology of the disease and development of new drug targets for various disorders.

NOV10

A disclosed NOV10 nucleic acid of 4660 nucleotides (also referred to as SC133419534_A) encoding a novel pregnancy zone protein precursor-like protein is shown in Table 10A. An open reading frame was identified beginning with an ATG initiation codon at nucleotides 141–143 and ending with a TAA codon at nucleotides 45784580. A putative untranslated region upstream from the initiation codon and downstream from the termination codon is underlined in Table 10A. The start and stop codons are in bold letters.

TABLE 10A

NOV10 nucleotide sequence (SEQ ID NO:35).

AATTCTGAACTCTATTCAGAGGCCTTGGGGTGGGGCTTGTTTGTACATAGTGGCCACATAAAGCCTGGTAAA

CTCAGCTGGTCTCCAGGGCGAGGCTGAGGGCAGAGAGTTGGACACAACCCTGAGATTTATCCCTCACAATGC

GGAAAGACAGACTTCTTCATTTATGTCTTGTGCTACTTCTTATCCTGCTTTCTGCCAGTGACTCAAACTCTA

CAGAACCGCAGTATATGGTGCTGGTCCCCTCCCTGCTCCACACTGAGGCCCCTAAGAAGGGCTGTGTCCTTC

TGAGCCACCTGAATGAGACAGTGACTGTAAGTGCTTCCTTGGAGTCTGGCAGGGAAAACAGGAGCCTCTTCA

CTGACCTGGTGGCGGAGAAGGACTTATTCCACTGTGTCTCCTTCACTGTGCCAAGGATCTCAGCCTCTTCAG

AGGTGGCATTCCTTAGCATCCAGATAAAGGGGCCTACGCAAGATTTCAGGAAGAGGAACACAGTTCTGGTAC

TGAACACCCAAAGTCTGGTCTTTGTCCAGACAGACAAACCCATGTATAAACCAGGACAGACAGGTAAGGTAA

GATTCCGTGTTGTCTCCGTGGATGAAAATTTTCGCCCTCGAAATGAACTGGTAAGCCTTGTTTCCCTTCAGA

ACCCAAGAAGAAATCGAATTGCACAATGGCAGAGTCTCAAGCTAGAAGCTGGCATCAATCAGTTGTCCTTTC

CCCTCTCATCAGAGCCCATTCAGGGCTCCTACAGGGTGGTGGTACAGACAGAATCAGGTGGAAGGATACAGC

ACCCCTTCACCGTGGAGGAATTTGTGCTTCCCAAGTTTGAGGTCAAAGTTCAGGTGCCAAAGATAATCAGTA

TCATGGATGAAAAAGTGAACATAACAGTCTGTGGATGTTATAGGTACACATATGGAGAGCCTGTCCCTGGTC

TGGTGACACTTAGTGTATGCAGAAGATATTCACTATGCCGTTCCGACTGCCACAACACACATTCACAGCTTA

ACAGCAATGGCTGCATCACCCAACAAGTACACACCAAAATGCTCCAGATTACAAATACGGGCTTTGAAATGA

AGCTTAGAGTGGAAGCCAGGATCAGAGAAGAGGGGACAGGTGTGGAAGTCACTGCAAACAGGATCAGTGAAA

TCACAAACATTGTATCCAAACTCAAATTCGTGAAAGTGGATTCACACTTTAGACAAGGAATCCCCTTTTTG

CACAGGTAAGACTGGTGGATGGAAAAGGTGTGCCCATCCCCAATAAACTCTTCTTCATCTCTGTGAATGACG

CCAATTATTACTCCAATGCAACCACCAATGAGCAGGGTCTTGCACAGTTTTCAATCAATACTACCAGTATCT

CGGTTAATAAACTTTTTGTCCGGGTAAGTTACAAAGAGAGTAACAATTGTTCTGATAACTGGTGGCTTGATG

AATTTCATACGCAAACATCTCATACTGCAAAGCATTTTTTTTCCCCAAGCAAGAGTTATATTCACCTCAAAC

CTATTATTGGTACTTTGACCTGTGGACAAACCCAGGAGATTCAAGCACACTACATTCTGAATAAACAGATTC

TCAGGGATGAAAAAGAATTAACCTTCTACTATTTGGTAAAAGCAAGAGGAAAAATCTCCCAATCAGGAATCC

ATGTGTTATCCATTGAACAAGGAAACAGTAAAGGCAGTTTTGCCTTATCCTTCCCTGTGGAGTCAGACGTTG

CCCCCATTGCACGAATGTTCATCTTTGCCATTTTACCAGATGGAGAAGTTGTTGGAGACTCTGAAAAATTTG

TABLE 10A-continued

NOV10 nucleotide sequence (SEQ ID NO:35).

AGATTGAAAACTGTCTAGCCAACAAGGTGGATTTGAGCTTCAGCCCAGCACAAAGTCCCCCAGCCTCACATG
CCCACCTGCAAGTAGCAGCTGCTCCGCAGTCCCTCTGTGCCCTTCGTGCTGTCGACCAAAGTGTGCTGCTCA
TGAAGCCTGAGGCTGAGCTCTCTGTGTCCTCAGTGTATAATCTGCTAACTGTGAAGGATCTCACCAATTTTC
CTGACAATGTGGACCAGCAGGAGGAAGAACAAGGACACTGTCCCCGTCCTTTCTTCATTCATAATGGAGCCA
TCTATGTTCCCTTATCAAGTAATGAAGCAGATATTTATAGCTTCCTCAAGGGGATGGGATTGAAGGTGTTCA
CTAACTCAAAAATCCGAAAACCAAAGTCGTGTTCAGTCATCCCTTCCGTGTCTGCAGGAGCAGTAGGTCAAG
GATACTATGGAGCAGGTCTAGGAGTAGTAGAGAGACCATATGTTCCTCAATTAGGCACATATAATGTGATAC
CCTTAAATAATGAACAAAGTTCAGGGCCAGTCCCTGAAACGGTGCGAAGCTATTTTCCTGAGACTTGGATCT
GGGAGTTGGTGGCAGTGAGCTCATCAGGTGTGGCTGAGGTAGGAGTAACAGTCCCTGACACCATCACCGAGT
GGAAGGCAGGGGCCTTCTGCCTGTCCGAAGATGCTGGACTTGGTATCTCTTCCACTGCCTCTCTCCGAGCCT
TCCAGCCCTTCTTTGTGGAGCTCACAATGCCTTACTCTGTGATTCGTGGAGAGGTCTTCACACTCAAGGCCA
CGGTCCTAAACTACCTTCCCAAATGCATCCGGGTAGTTGTGCAGCTGGAGGTCTCTTCCGCTTTCCTGGCTG
TTCCAACAGAGAAGAATGAAGAATCTCACTGTGTCTGTAGAAATGGGCGGAAAACCGTGTCCTGGGTTGTGA
CTCCGAAGTCACTGGGTAATGTGAACTTCTCAGTGAGTGCAGAGGCAATGCAGTCCTTAGAACTCTGTGGAA
ATGAGGTTGTTGAGGTCCCTGAGATTAAAAGAAAAGACACAGTCATCAAAACCCTGTTGGTGGAGCCTGAAG
GAATAGCAAAGGAGGAAACTTTCAACACGCTGCCCTGTGCATCAGGTGCTAATGTGTCTGAGCAGTTGTCCT
TGAAGCTCCCATCAAATGTGGTCAAAGAATCTGCCAGAGCTTCTTTCTCAGTTCTGGGTGGTGACATATTAG
GTTCTGCTATGCAAAATATACAAAATCTCCTCCAGATGCCATATGGCTGTGGAGAACAGAACATGGTCCTAT
TTGCTCCTAACATCTATGTCTTGAACTATCTGAATGAAACCCAGCAGCTGACGCAGGAGATCAAGGCCAAGG
CCGTTGGCTATCTCATCACTGGTTACCAGAGACAGCTGAACTACAAACACCAAGATGGCTCCTACAGCACCT
TTGGGGAACGATATGGCAGGAACCAGGGCAACACTTGGCTCACAGCTTTTGTACTGAAGACTTTCGCCCAGG
CTCGATCCTACATCTTCATTGATGAAGCACACATTACCCAATCTCTCACGTGGCTCTCCCAGATGCAGAAGG
ACAATGGCTCTTTCAGGAGCTCTCGGTCACTGCTCAACAATGCCATAAAGGGAGGTGTAGAAGATGAAGCGA
CCCTCTCCGCCTATGTTACTATTGCCCTTCTGGAAATTCCTCTCCCAGTCACTAACCCTATTGTTCGCAATG
CCCTGTTCTGCCTGGAGTCAGCCTGGAATGTAGCAAAGGAGGGGACCCATGGGAGCCATGTCTACACCAAGG
CATTGCTCGCCTATGCTTTTTCCCTACTCGGAAAGCAAAATCAGAATAGAGAAATACTGAACTCACTTGATA
AGGAAGCTGTGAAAGACAACCTCGTCCATTGGGAGCGCCCTCAGAGACCCAAGGCACCAGTGGGCATCTTT
ACCAAACCCAGGCTCCCTCTGCTGAGGTGGAGATGACATCCTATGTGCTCCTCGCTTATCTCACGGCCCAGC
CAGCCCCCACCTCAGGGGACCTGACCTCTGCAACTAACATTGTGAAGTGGATCATGAAGCAGCAGAACGCCC
AAGGTGGTTTCTCCTCCACCCAGGACACAGTGGTGGCTCTCCATGCCCTGTCCAGGTATGGAGCAGCCACTT
TCACCAGAACTGAGAAAACTGCACAGGTCACCGTTCAGGATTCACAGACCTTTTCTACAAATTTCCAAGTAG
ACAACAACAACCTCCTATTACTGCAGCAGATCTCATTGCCAGAGCTCCCTGGAGAATATGTCATAACAGTAA
CTGGGGAAAGATGTGTGTATCTTCAGACATCCATGAAATACAATATTCTTCCAGAGAAAGAGGACTCCCCAT
TTGCTTTAAAAGTGCAGACTGTGCCCCAAACTTGCGATGGACACAAAGCCCACACCAGCTTTCAGATCTCAC
TGACCATCAGTTACACAGGAAACCGTCCTGCTTCCAATATGGTGATTGTTGATGTAAAGATGGTATCTGGTT
TTATTCCCCTGAAACCAACAGTAAAAATGCTTGAAAGATCTACGTCTGTGAGCCGGACAGAAGTGAGCAACA
ACCATGTCCTCATTTATGTGGAACAGGTGCTAACCCATCAAACCCTGCATTTTCCTTCTTTGTGGAACAAG
ACATCCAAATAAAGAATTTAAAACCAGCTACAGTAAAAGCCTATGATTATTATGAGACATCAGATGAATTCA

TABLE 10A-continued

NOV10 nucleotide sequence (SEQ ID NO:35).

CCTTTGAAGAATACAATGCCCCTTGCAGTGCTGGTAAAGTATAAATGATTCAATCTAATGCCACTTGAAAGA
AAATAAATAAGCATCTCAGTTAAACAGTAAAGTCTAATCCCAACTTCAAAAT

In a search of public sequence databases, the NOV10 nucleic acid sequence, localized to chromosome 12, has 4170 of 4478 bases (93%) identical to a gb:GENBANK-ID:HSPZHEP|acc:X54380 mRNA from *Homo sapiens* (Human mRNA for pregnancy zone protein (E=0.0). Public nucleotide databases include all GenBank databases and the GeneSeq patent database.

The disclosed NOV10 polypeptide (SEQ ID NO: 36) encoded by SEQ ID NO: 35 has 1479 amino acid residues and is presented in Table 10B using the one-letter amino acid code. Signal P, Psort and/or Hydropathy results predict that NOV10 has no signal peptide and is likely to be localized extracellularly with a certainty of 0.8200. In other embodiments, NOV10 may also be localized to the lysosome (lumen) with a certainty of 0.1900, the endoplasmic reticulum (membrane) with a certainty of 0.11000, or in the endoplasmic reticulum (lumen) with a certainty of 0.11000. The most likely cleavage site for NOV10 is between positions 23 and 24: SDS-NS.

TABLE 10B

Encoded NOV10 protein sequence (SEQ ID NO:36).

MRKDRLLHLCLVLLLILLSASDSNSTEPQYMVLVPSLLHTEAPKKGCVLLSHLNETVTVSASLESGRENRSL
FTDLVAEKDLFHCVSFTVPRISASSEVAFLSIQIKGPTQDFRKRNTVLVLNTQSLVFVQTDKPMYKPCQTGK
VRFRVVSVDENFRPRNELVSLVSLQNPRRNRIAQWQSLKLEAGINQLSFPLSSEPIQGSYRVVVQTESGGRI
QHPFTVEEFVLPKFEVKVQVPKIISIMDEKVNITVCGCYRYTYGEPVPGLVTLSVCRRYSLCRSDCHNTHSQ
LNSNGCITQQVHTKMLQITNTGFEMKLRVEARIREEGTGVEVTANRISEITNIVSKLKFVKVDSHFRQGIPF
FAQVRLVDGKGVPIPNKLFFISVNDANYYSNATTNEQGLAQFSINTTSISVNKLFVRVSYKESNNCSDNWWL
DEFHTQTSHTAKHFFSPSKSYIHLKPIIGTLTCGQTQEIQAHYILNKQILRDEKELTFYYLVKARGKISQSG
IHVLSIEQGNSKGSFALSFPVESDVAPIAPMFIFAILPDCEVVGDSEKFEIENCLANKVDLSFSPAQSPPAS
HAHLQVAAAPQSLCALRAVDQSVLLMKPEAELSVSSVYNLLTVKDLTNFPDNVDQQEEEQGHCPRPFFIHNG
AIYVPLSSNEADIYSFLKGMGLRVFTNSKIRKPKSCSVIPSVSAGAVGQGYYGAGLGVVERPYVPQLGTYNV
IPLNNEQSSGPVPETVRSYFPETWIWELVAVSSSGVAEVGVTVPDTITEWKAGAFCLSEDAGLGISSTASLR
AFQPFFVELTMPYSVIRGEVFTLKATVLNYLPKCIRVVVQLEVSSAFLAVPTEKNEESHCVCRNGRKTVSWV
VTPKSLGNVNFSVSAEAMQSLELCGNEVVEVPEIKRKDTVIKTLLVEPEGIAKEETFNTLPCASGANVSEQL
SLKLPSNVVKESARASFSVLGGDILGSAMQNIQNLLQMPYGCGEQNMVLFAPNIYVLNYLNETQQLTQEIKA
KAVGYLITGYQRQLNYKHQDGSYSTFGERYGRNQGNTWLTAFVLKTFAQARSYIFIDEAHITQSLTWLSQMQ
KDNGCFRSSGSLLNNAIKGGVEDEATLSAYVTIALLEIPLPVTNPIVRNALFCLESAWNVAKEGTHGSHVYT
KALLAYAFSLLGKQNQNREILNSLDKEAVKDNLVHWERPQRPKAPVGHLYQTQAPSAEVEMTSYVLLAYLTA
QPAPTSGDLTSATNIVKWIMKQQNAQGGFSSTQDTVVALHALSRYGAATFTRTEKTAQVTVQDSQTFSTNFQ
VDNNNLLLLQQISLPELPGEYVITVTGERCVYLQTSMKYNILPEKEDSPFALKVQTVPQTCDGHKAHTSFQI
SLTISYTGNRPASNMVIVDVKMVSGFIPLKPTVKMLERSSSVSRTEVSNNHVLIYVEQVLTHQTLHFSFFVE
QDIQIKNLKPATVKAYDYYETSDEFTFEEYNAPCSAGKV

A search of sequence databases reveals that the NOV10 amino acid sequence has 1348 of 1475 amino acid residues (91%) identical to, and 1387 of 1475 amino acid residues (94%) similar to, the 1482 amino acid residue ptnr:SWISSPROT-ACC:P20742 protein from *Homo sapiens* (Human) (Pregnancy Zone Protein Precursor (E=0.0). Public amino acid databases include the GenBank databases, SwissProt, PDB and PIR.

NOV10 is predicted to be expressed in late-pregnancy sera because of the expression pattern of (GENBANK-ID: gb:GENBANK-ID:HSPZHEP|acc:X54380) a closely related mRNA for pregnancy zone protein homolog in species *Homo sapiens*.

The disclosed NOV10 polypeptide has homology to the amino acid sequences shown in the BLASTP data listed in Table 10C.

TABLE 10C

BLAST results for NOV10

| Gene Index/Identifier | Protein/Organism | Length (aa) | Identity (%) | Positives (%) | Expect |
|---|---|---|---|---|---|
| gi\|13651966\|ref\|XP_006924.3\| (XM_006924) | pregnancy-zone protein [Homo sapiens] | 1242 | 1063/1239 (85%) | 1097/1239 (87%) | 0.0 |
| gi\|6680608\|ref\|NP_031402.1\| (NM_007376) | alpha-2-macroglobulin [Mus musculus] | 1495 | 826/1479 (55%) | 1048/1479 (70%) | 0.0 |
| gi\|1171932\|sp\|P20740\| OVOS_CHICK | OVOSTATIN PRECURSOR (OVOMACROGLOBULIN) | 1473 | 612/1468 (41%) | 900/1468 (60%) | 0.0 |
| gi\|224053\|prf\|\|1009174A | macroglobulin alpha2 [Homo sapiens] | 1450 | 1012/1469 (68%) | 1164/1469 (78%) | 0.0 |
| gi\|6678964\|ref\|NP_032671.1\| (NM_008645) | murinoglobulin 1 [Mus musculus] | 1476 | 802/1466 (54%) | 1034/1466 (69%) | 0.0 |

The homology between these and other sequences is shown graphically in the ClustalW analysis shown in Table 10D. In the ClustalW alignment of the NOV10 protein, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 10D

ClustalW Analysis of NOV10

1) Novel NOV10 (SEQ ID NO:36)
2) gi|13651966|ref|XP_006924.3| (XM_006924) pregnancy-zone protein [Homo sapiens] (SEQ ID NO:110)
3) gi|6680608|ref|NP_031402.1| (NM_007376) alpha-2-macroglobulin [Mus musculus] (SEQ ID NO:111)
4) gi|1171932|sp|P20740|OVOS_CHICK OVOSTATIN PRECURSOR (OVOMACROGLOBULIN) (SEQ ID NO:112)
5) gi|224053|prf||1009174A macroglobulin alpha2 [Homo sapiens] (SEQ ID NO:113)
6) gi|6678964|ref|NP_032671.1| (NM_008645) murinoglobulin 1 [Mus musculus] (SEQ ID NO:114)

```
                           10        20        30        40        50        60
                   ....|....|....|....|....|....|....|....|....|....|....|....|
NOV10              ----MRKDRLLHLCLV---------ELNILLSASDSNSTEPQYMVLVPSLLHEDAPKKGC    47
gi|13651966|ref    ------------------------------------------------------------     1
gi|6680608|ref|    ----MRRNQLPTPAFLL--------EFELLPRDATTATAKPQYVVLVESEVYQESLKRPC    48
gi|1171932|sp|P    MHCFEGREILSFFCLTVRKMWLKFIEATLLLHAAAGKEPEPQYVEMVEAVLQSESPSQVC    60
gi|224053|prf||    ---------------------------------SVSGKPQYMVLVPSLLHEDITEKGC     25
gi|6678964|ref|    ----MWKSRRAQLCLFS--------VLEAFLHSASLLNGDSKYMVLVPSQLYEDIPEKIC    48

70        80        90       100       110       120
                   ....|....|....|....|....|....|....|....|....|....|....|....|
NOV10              VLESHLNETVIVSASLESGRENRSLFTDLVAEKDLFHCYSETVPRISASSEVAEKSIQIK   107
gi|13651966|ref    ------------------------------------------------------------     1
gi|6680608|ref|    VSLNHVNETVMLSLTLEYAMQQTKLLTKQAVDKDSFYCSPEIES--GSPLPYTESTVEIK   106
gi|1171932|sp|P    IQFFNLNQTISVRVVLEYDTINTTIFEKNTTTSNGLQCENEMEPP-VISVSLAEISFTAK   119
gi|224053|prf||    VLISYLNETVIVS-ALESVRGNRSLFTDLEAENDVLHCVAEAVPKSSSNEEVMELTVQYK    84
gi|6678964|ref|    EHEYQLNETVIVEASLVSQSGRKNLFDKLVLDKDLFQCVSEIIERLSESDEEDEKYYDIK   108

130       140       150       160       170       180
                   ....|....|....|....|....|....|....|....|....|....|....|....|
NOV10              GPTQDFRKRNTVLVLKTQSLVFVQTDKEMYKPGCIGKVFRVVSVDENERPRNEIVSLYS   167
gi|13651966|ref    ------------------------------------------------------------     1
gi|6680608|ref|    GPTQREIKKKSIQIIKASPVFVQTDKEYYKPGCI--VKFRVVSVDISERPKNETFEYYY   164
gi|1171932|sp|P    GTIFDLKERRSVMIWNMESFVFVQTDKEMYKPGCS--VMFRVVAIDFNEKPVQDMYPIA   177
gi|224053|prf||    GPTQREFKRTIVWVKNESLVFVQTDKSEYKPGCI--VKFRVVSMDENFHPENEEIPIKY   142
gi|6678964|ref|    GPTHELSKEKAVLVKNKESVVFVQTDKEYYKFGCS--VKFRVVSMDKMLRPENEILPIAY   166

190       200       210       220       230       240
                   ....|....|....|....|....|....|....|....|....|....|....|....|
NOV10              LQMERRNRIAQWQSEKLEAGINQESFPLESEPIQGSYRVVQTKSGGRIQHPPTVEERVL   227
gi|13651966|ref    ------------------------------------------------------------     1
gi|6680608|ref|    ESTEKRNRIFQWQNIHLAGGHHQESFPLSVEEALGIYKVVQKDSGKNIQHSPEVKEVL   224
gi|1171932|sp|P    VQPPQNNRIFQWQRVTSEINIVQKEFPLKEEPILGNYKIIVTKKSGERTSHSPLVEEVL   237
gi|224053|prf||    IQPEKGNRIAQWQSFQLEGGIKQFSFPLESEPFQCSYKVVVQKSGGRTEHPPTVEEVL   202
gi|6678964|ref|    EEDEKNRIMQWRDIKTENGIKQMSFSLAAEPIQGPYKIVVHKSGEMESHSPTVMEEVL   226
```

TABLE 10D-continued

ClustalW Analysis of NOV10

```
                        250        260        270        280        290        300
                 ....|....|....|....|....|....|....|....|....|....|....|....|
NOV10            PKF VKYQVEKII IMDE VNI TVCCCYRYTYG PVPGLVTL SVCRR SLCR--------     279
gi|13651966|ref  ---------------MDEKVNI TVCC--EYTYGKPVPGLATVSLCRKISRVL-NCD---K     39
gi|6680608|ref|  PKF VI KMQKTMAFLEE KPI TACG--VYTYGKPVPGLVTIRVCRK SRYRSTCHNQNS     282
gi|1171932|sp|P  PKF DVTVTA GSLTVMDSEITVK ICA--VYTYGQPVEGKVQLSVCRDRDSYG-RCK---K     291
gi|224053|prf|   PKF VQVTVEKILTILEERMVSVCC--LYTYGKPVPGHVTVSICRKVSDAS-DCHGEDS     259
gi|6678964|ref|  PRENVDEKVENAMSVNDEVLSVTACG--KYTYGEPVPGHVKIDVCRETETG---------    275

310        320        330        340        350        360
                 ....|....|....|....|....|....|....|....|....|....|....|....|
NOV10            -SDCHNTHSQLNSNGCITQQVHTKMLQTTNTGPEMKLR-VEARIREEGTCVEVTANRISE     337
gi|13651966|ref  QEVCESESQLNSKGCITQQVHTKMLQTTNTGPEMKLR-VEARIREEGTDVEVTANRISE      98
gi|6680608|ref|  MSICAKE SQCAEDKGCFSQVVKTKVFQLSQKGHEMKEE-VEAKIEBEGTCIELTGIGSCP     341
gi|1171932|sp|P  SPVCQSEIKDLDTDGCLSHILSSKVFEINRIGYKRNLD-VKAIVTEKEQVCNLTATQSIS     350
gi|224053|prf|   QAFCEKESGQLNSKGCFYQCVKTKVFQLKRKEXEMKLH-TEAQIBEEGTVVELIGROSSE     318
gi|6678964|ref|  ---CREVNSQLDNNGCSIQSVNITELQSKKRNYLVQLFHVNATVTEEGTGLEFSRSGIIK     332

370        380        390        400        410        420
                 ....|....|....|....|....|....|....|....|....|....|....|....|
NOV10            ITNIYSKLKFVKVDSHFRQGIPFFAQVRLVDGKGVPIPNKLFFISVNCANYYSNATTNEQ     397
gi|13651966|ref  ITNIYSKLKFVKVDSHFRQGIPFFAQVLLVDGKGVPIPNKLFFISVNCANYYSNATTNEQ     158
gi|6680608|ref|  TANALSKLGTKVXTNVRPCLPFSGQVLLVDEKGKPIPNKINITSVVSPLGYLSIFTTDEF     401
gi|1171932|sp|P  ITQVNSSLFENVDHHYRCGIPNFGCIKLVDKDNSPISNKVIQLFVNNKTHN-FTTDIN    409
gi|224053|prf|   ITRTINKLSFVKVDSHFRQGIPFFCQVLLVDGKGVPIPNKVIFIRGNEANYYSNATTDEF     378
gi|6678964|ref|  IERSTNKLIFLKADSHFRHGIPFFVKVRLVDIKGDPIPNEKVFIKAQELSYTSATTTDQX     392

430        440        450        460        470        480
                 ....|....|....|....|....|....|....|....|....|....|....|....|
NOV10            GLAQFSINTISISVNKLFVFVSYKESNNCSDNWXLDEFHTQTSHEAKHFFSPSKSYIHLK     457
gi|13651966|ref  GLAQFSINTISISVNKLFVFVFTVHPNLCFHYSWYAEDHQGAQHFANRVFSLSGSYIHLE     218
gi|6680608|ref|  GLANISIDTSKFIAPFLRVVVTYKQNHVCYDNWHDEFHTQADHEATLVFSPSCSYIQLE     461
gi|1171932|sp|P  GTAPFSIDTSKIFDPELSLKALYKTSDQCHSEGWLEPSYPDASLEVQRESWISSRVRIE     469
gi|224053|prf|   GLVQFSINTTNVMGTSLTVEVNYKDRSPCYGYQWYSEEHEEAHHEAYLVFSPSKSEVHLE     438
gi|6678964|ref|  GLAKFSIDTTCISGSSLHIKVNEKEELSCSYFYCHIERHASAKHEVAYAVKSLSKSYIMLD     452

490        500        510        520        530        540
                 ....|....|....|....|....|....|....|....|....|....|....|....|
NOV10            PIIG-TLTCGQTCPIQAHYILNKQILRDEKNITFYYLVKAPGKTSQSGIHVLSIDQCNS-     515
gi|13651966|ref  PVAG-TLPCGHTETITAHYTLNRQAMGELSELSFYLMAKGVITVRSCTHTLPVESGHM-     276
gi|6680608|ref|  LVFG-TLACGQTQEIRIHYKLNEDIMKNEKITLTFYYLKKARGSIGNLGSHVLSEKCGNM-     519
gi|1171932|sp|P  PLWK-DMSCGQKRMITVKYILNTEGEYEHNIVNFYYVGMAKGKIVYLTGEIKVNIQADQN-     527
gi|224053|prf|   PMSH-ELPCGHTQTVQAHYILNGGTITLGLKKLSFYYLMAKGGITVRTGTHGLLVKQEIM-     496
gi|6678964|ref|  TETSSILPCNQIHTVQAHFFILKG-DLGVKKQLIFYYLVMACGSIXQTGNHTHQVEPCEAP     511

550        560        570        580        590        600
                 ....|....|....|....|....|....|....|....|....|....|....|....|
NOV10            -KGSEALSFFVESDVAPIARMFISAILPGEVVGDSEKFEIENCLANKVDLSFSPAQSPP     574
gi|13651966|ref  -KGSEALSFFVESDVAPIARMFIKAILPGEVVGDSEKFEIENCLANKVDLSFSPAQSPP     335
gi|6680608|ref|  -KGVPSLPICVEPGMAPEAQLIYAILPNPEFVADAQNFEIEKCFANKVMLSFPSAQSLP     578
gi|1171932|sp|P  -GTEMTPLVVNEKMAPAIRLNYMTHPAKELVADSVRFSTEKCFKNKVQIQFSEKQMLT     585
gi|224053|prf|   -KGHPSISFPVKSDVAPVARLLIYAVLPTGDVIGDSAKXXVENELANKVDLSFSPSQSLP     555
gi|6678964|ref|  VKGKPALELPVEFSMVPMAKMLIYTLLPGGEVIADSVNFEIEKCLRNKVDLRFSTLQSLP     571

610        620        630        640        650        660
                 ....|....|....|....|....|....|....|....|....|....|....|....|
NOV10            ASHAHLQVAAAFQSLCALRAVDQSVLLKPEAELSVSSVYNLLTVKDLT-NFPDNVDQQK     633
gi|13651966|ref  ASHAHLQVAAAFQSLCALRAVDQSVLLKPEAELSVSSVYNLLTVKDLT-NFPDNVDQQK     394
gi|6680608|ref|  ASDTHLKVKAAPLSLCALTAVDQSVLLKPEALSPQSYNLHPVYNLQGYIFNGIMLED     638
gi|1171932|sp|P  TSNVSLVIEEAAANSFCAVRAVDKSSLLLKSPETELSAETEYNLHPICDLQGYIFNGIMLED     645
gi|224053|prf|   ASHAHLRVTAAPQSKCALRAVDQSVLLKFSAELSASSSYNLLPEKDLT-GFPGPLNDCD     614
gi|6678964|ref|  ASQTRLQVTASFQSLCGIRAVDQSVLLKPESELSPSWIYNLPGMQQNK-FVPSSRLSED     630

670        680        690        700        710        720
                 ....|....|....|....|....|....|....|....|....|....|....|....|
NOV10            --EDGHCPRPFKIHNGAIYVPLES-NEADRYSFIKGMLKVFTNSKIRKPRSCSVIPSV     690
gi|13651966|ref  --EDQGHCPRPFKIHNGAIYVPLES-NEADRYSFIKGMLKVFTNSKIRKPRSCSVIPSV     451
gi|6680608|ref|  --HENCISGEDITHN-GIVYTPKHSLGENDAHSIFQSYCINIFTNSKIHKPRFCQEFQHY     695
gi|1171932|sp|P  DPQDPCVSSDDIEHK-GLYYRPLTSGLGPDVYQFIRDMGVEFFTNSKIRQPTVCTRETVR     704
gi|224053|prf|   --DDCINRHNVYIN-GITYTPVSSTNEKDKYSFIEDMGLKAFTNSKIRKPKMCPQLQQY     671
gi|6678964|ref|  --QEDCILYSSWLAEKHTNLVPHGE--EKDYKYRXVEDMGLTAFTNLMIKLPIICFDYGMV     686

730        740        750        760        770        780
                 ....|....|....|....|....|....|....|....|....|....|....|....|
NOV10            SAGAVGQGYYGAGLCVVERPYVPQLCTYNN-IPLNNEQSSG-PVPETVRSYFPETWIWEL     748
gi|13651966|ref  SAGAVGQGYYGAGLCVVERPYVPQLCTYNN-IPLNNEQSSG-PVPETVRSYFPETWIWDL     509
gi|6680608|ref|  PAMGGVAPQALAVAASGPGSSFRAMGCIDYSDEINQVVEMRETVRKYFPETWIWDI     755
gi|1171932|sp|P  PPS------YFLNACFTASTHHVKLSAEVA----REERGKR-HILETIRESFPETWIWDR     753
gi|224053|prf|   EM----HGPEGLRVCFYES-DVMGRGHARI-VHVEEPHI------ETVRKYFPETWIWDI     719
gi|6678964|ref|  PISAPRVEFDLAFTPEISWSLRTTLSKRPE-EPPRKDPSSNDPETETIEKYFPETWVKLX     745
```

TABLE 10D-continued

ClustalW Analysis of NOV10

```
                  790       800       810       820       830       840
                 ....|....|....|....|....|....|....|....|....|....|....|....|
NOV10            VAVSSGVAEVGVTVPDTITEWKAGAFCLSEDAGLGSSTASLAFQPFFVELTMPYSVI      808
gi|13651966|ref  VAVSSGVAEVGVTVPDTITEWKAGAFCLSEDAGLGSSTASLAFQPFFVELTMPYSVI      569
gi|6680608|ref|  VPLVSGDGEAVKVPDTITEWKGSGTTGLGSSSTISLAFQPFFMELIAPYSVV          815
gi|1171932|sp|P  ELINSTGKASVSYTTPDTITEWKASAFCVEELAGFGMSVPATLTAFQPFFVQLTTPYSTI    813
gi|224053|prf|   VVNSAGVAEVGVTVPDTITEWKAGAFCLSEDAGLGSSTASLAFQPFFVELTMPYSVI      779
gi|6678964|ref|  VTVNSTGEAEVEMTVPDTITEWKAGALCLSNDTGLGSSVVPLQAFKPFFVENIIPYSVV    805

850       860       870       880       890       900
                 ....|....|....|....|....|....|....|....|....|....|....|....|
NOV10            RGEVFTLKATVLNYLPKCIRVVQLEVSSAFLAVPTEKNEESHCYCRNGRKTVSWVVTPK    868
gi|13651966|ref  RGEVFTLKATVLNYLPKCIRVKASEAFLASQNTKGERSYCCGNERKTLSWIVTPK       629
gi|6680608|ref|  RGEAFTLKATVLNYMSHCIQHRVDLEISPDFLAVENGGHENSHCECGNERKTVSWAVTPK  875
gi|1171932|sp|P  HGEDFLVEANVFNYLNHCIKINVLLLESLDMQAKLISP-ERDGCVCAKIRKSYVWNTFPK  872
gi|224053|prf|   RGEAFTLKATVLNYLPKCIRVSELEASPAFLAVEVEKEQAPHCICANGRQTVSWAVTPK   839
gi|6678964|ref|  RGEAFMLKATVMNYLPTSMQMEVQLDASPDFTAVPVGDDQSVCESANGRHTSSWLVTPK    865

910       920       930       940       950       960
                 ....|....|....|....|....|....|....|....|....|....|....|....|
NOV10            SLGNVMFSVSAEAKGSLELCGNEVVEVPEIKRKDTVIKTLLVEPEGIAKENTFNLLPCAS   928
gi|13651966|ref  SLGNVMFSVSAEANGSLELCGNEVVEVPEIKRKDTVIKTLLVEABGIEKDKTFSSMTCAS   689
gi|6680608|ref|  SLGEVNFIRSAEAKSQELCGNETEVPAIVHKDTVVKSVTVEPGIERKTDTYNLLLCPQ    935
gi|1171932|sp|P  GTGDVLFSINAETNDD-EACEEEALRNIRTDYRDTQIRALLVEPEGIRRBETQNFLICMK   931
gi|224053|prf|   SLGNVNFIIVSAEAIESQELCGTEVPSVPEHGRKDTVIKPLLVEPEGLEKKTTFNSLLCPS  899
gi|6678964|ref|  SLGNVMFSVSAEAQGSSEPCGSEVATVPATGRKDTVWKVLIVEPEGIKSHTFSSLFCAS   925

970       980       990      1000      1010      1020
                 ....|....|....|....|....|....|....|....|....|....|....|....|
NOV10            GANVSEQRSLKLPSNVVKKSARASFSVLGCDILGSAMQNTQNLLQMPYGCGEQNMVLFAP   988
gi|13651966|ref  GANVSEQRSLKLPSNVVKKSARASFSVLG-DILGSAMQNTQNLLQMPYGCGEQNMVLFVP   748
gi|6680608|ref|  DTELQENSLEKLPPNVVIGSARATHSVLG-DILGSAMQNEQNLLQMPYGCGEQNMVLFVP   994
gi|1171932|sp|P  DDVISQDVATDLPTNVVGSPRPSFSVAG-DINGEATQNVHQLLQMPFGNGEQNMVLFAP   990
gi|224053|prf|   GGEVSEELSLKLPPNVVKKSARASVSVLG-DILGSAMQNTQNLLQMPYGCGEENMVLFAP   958
gi|6678964|ref|  DAEISEKMSSGPPPTVVKKSARAHFSVKG-DILSSAIRNTQNPLHMPYGCGEQNMVLFAP   984

1030      1040      1050      1060      1070      1080
                 ....|....|....|....|....|....|....|....|....|....|....|....|
NOV10            NIYVLNYLNETQQLTQRIKAKAVGYLTTGYQRQLNYKHQDGSYSTFGERYGRNQ-GNTWL  1047
gi|13651966|ref  NIYVLNYLNETQQLTQEIKAKAVGYLTEGYQRQLNYKHQDGSYSTFGERYGRNQ-GNTWL   807
gi|6680608|ref|  NIYVLNYLNETQQLTEAIKSKAINYLNGYQRQLNYQHSDGSYSTFGNHGGNTPGNTWL    1054
gi|1171932|sp|P  NIYVLDYLSNTRQLSHDVKTGYLNGYQKQLSYKHPDGSYSTFGIRDKE--GNTWL     1047
gi|224053|prf|   NIYVLCYLNETQQLTPEIKAKGYLNTGYQRQLNYKHYDGSYSTFGERYGRNQ-GNTWL   1017
gi|6678964|ref|  NIYVLKYLNETQQLTQKIKKALGKLRAGYQRELNYKHKDGSYSAFGEQNGERE-GNTWL   1043

1090      1100      1110      1120      1130      1140
                 ....|....|....|....|....|....|....|....|....|....|....|....|
NOV10            TAFVLKDFAQAFSYIFIDEHHITQSITWLSQMQKDNGCFRSSGSLLNNAAIKGGVEDEATL  1107
gi|13651966|ref  TAFVLKDFAQAFSYIFIDEHHITQSLTWLSQMQKDNGCFRSSGSLLNNAAIKGGVEDEATL   867
gi|6680608|ref|  TAFVLKAFAQAQFIFIEKTHITNAFNWLSMQKENGCFQOSGYLLNNAAIKGGVLDEVTL   1114
gi|1171932|sp|P  TAFVYKSFATASRKTKIDLNVQAQTLIWLATKQKTEGCFSQGILVNNAAIKGGVENEISL  1107
gi|224053|prf|   TAFVLKDFAQARAIFIDESHHITQDLIWLSQKQKDNGCFRSSGSLLNNAAIKGGVEDEVTL  1077
gi|6678964|ref|  TAFVLKRFAQARAFIFIDESHITHAFTWLSQKKDNGCFRSSGSLFNNAKGGVEDEMTL    1103

1150      1160      1170      1180      1190      1200
                 ....|....|....|....|....|....|....|....|....|....|....|....|
NOV10            SAYYTIALLEEPLPVTNPEVRNALFCLESAWNVAKEGTHGSHVYTKALLAYAFSLLGKQN   1167
gi|13651966|ref  SAYYTIALLEMPLPVTNPEVRNALFCLESAWNVAKEGTHGSHVYTKALLAYAFSLLGKQN    927
gi|6680608|ref|  SAYITIALLESPLPVTHSAVRNALFEEATIAWASISQ-SQEBSHVYTKALLAYAFALAGNKA  1173
gi|1171932|sp|P  SAYITIALLEAGHSMSHTVIRNAFYCLENASE-----KNIILDIYTQALVAYAFCLAGKAE  1162
gi|224053|prf|   SAYIKIALLEIPITVTHPVVRNALFCLESAWKTAIKGDHGSHVYTKALLAYAFALAGNQS  1137
gi|6678964|ref|  SAYITTMALLESSLPATHPVVSKALSCLESSWKTISQERNASFVYTKALMAYAFALAGNQN  1163

1210      1220      1230      1240      1250      1260
                 ....|....|....|....|....|....|....|....|....|....|....|....|
NOV10            CNRESLNSLFKEAVK-DNLYHWERP-QRPKAPVGHLYQTQAPSAEVMTSYVLLAYLTAQ   1225
gi|13651966|ref  CNRESLNSLFKEAVKEDNLHHWERP-QRPKAPVGHLYQTQAPSAEVMTSYVLLAYLTAQ    986
gi|6680608|ref|  KRSESELESLKQAVKEESHWERPGDVQKVKALSFYQPRAPSAEVMTIYVLLAYLTSE     1233
gi|1171932|sp|P  ICESFLRELQKSAKEVDGSKVWEON---QRSAPEKSHLLDHVQSTVEITSYVLLALLYK-  1219
gi|224053|prf|   KRKEVLKSLNFEEAVKRDNSTHWERB-QKPKAPVGHFYKPQAPSSAEVMTSYVLLAYLTAQ  1196
gi|6678964|ref|  KRDEILKSLSEEARKENNSRHWKRP-QKSKRSEHHLYKPQASSAEVMNAYVLLARLTAQ   1222

1270      1280      1290      1300      1310      1320
                 ....|....|....|....|....|....|....|....|....|....|....|....|
NOV10            PAP-----ESGDLTSATNIVKWIMKQQNAGGFSSTQDTVVALHALSRYGAATFIRTEEKT  1280
gi|13651966|ref  PAP-----ESGDLTSATNIVKWIMKQQNAGGFSSTQDTVVALHALSKYGAATFTRTEEKT  1041
gi|6680608|ref|  SSRPTRDLSSDLSTAKTIVKWINSDGGLLLTTQDTVVALQALSKYGATFTRSQKE       1293
gi|1171932|sp|P  PNR-----MQEDLTKASATIVQWIIRQQNSYGGFASMQDTVVALQALAAYGAATVN-SVTQ  1273
gi|224053|prf|   PAP-----ESEDLTSATNIVKWITKQQNAGGFSSTQDKVVALHALSKYGAATFTRTGKA  1251
gi|6678964|ref|  PAP-----ESPEDLTLSMSTMVWITKQQNSNGGFSSTQDTVVALDALSKYGAVTESREQKT  1277
```

TABLE 10D-continued

ClustalW Analysis of NOV10

```
                     1330       1340       1350       1360       1370       1380
                 ....|....|....|....|....|....|....|....|....|....|....|....|
NOV10            AQVTQDSQTFSTNFQVCNNNLLLLQQISLPELPGSYVIIVIGERCVYLQTSMKYNILPE      1340
gi|13651966|ref  AQVTQDSQTFSTNFQVDNNLLLLQQISLPELPGIYVIIVIGERCVYLQTSMKYNILPE      1101
gi|6680608|ref|  VLVISRSSGTFSKTEHVNSCNRLLLQSVRLPELPGNYVTKGSGSGCVYLQTSLKYNILPV    1353
gi|1171932|sp|P  NVIIKENSKNTFEKVEIVINENRLLLQQTPLPQVPGKYSIIVNGTGCVLIQTALRYNIHLP   1333
gi|224053|prf|   AQVIIQSSGTFSSKFQVDNNRLLLQQVSLPELPGIYSMKVIGEGCVYLQTSLKYNILPE      1311
gi|6678964|ref|  TLVIIROSIGSFSQKFQVENSNRLLLQQVALPDIPGIYTIIVSGEGCVYAQTMLRYNMHLE   1337

1390       1400       1410       1420       1430       1440
                 ....|....|....|....|....|....|....|....|....|....|....|....|
NOV10            KE-DSPFALKVQTVPQTCDGHKAHTSFQISLTTISYTGKRPASKMVIVDVKMVSGFIPLKP    1399
gi|13651966|ref  KE-DSPFALKVQTVPQTCDGHKAHTSFQISLTISYTGNRPASKMVIVDVKMVSGFIPLKP     1160
gi|6680608|ref|  AEGKAPFALQVNTLPLNFDKAEDHRIFQIRINYSYTGERPSSKMVIVDVKMVSGFIPMKP    1413
gi|1171932|sp|P  EG-AFGFSLSVQTSNASCPRDQPGK-FDIVLISSYTGKRSESKMVIDDVKMSSGFYPYKS    1391
gi|224053|prf|   KE-EFPFALGVQTIPQTCDEPKAHTSFQISLSVSYTGRSASKMAIVDVKMVSGFIPLKP     1370
gi|6678964|ref|  KQ-LSAFARWVQTVPLTCKNPKGHNSFQISLEISYTGSRPASKMVIADVKMSSGFIPLKP    1396

1450       1460       1470       1480       1490       1500
                 ....|....|....|....|....|....|....|....|....|....|....|....|
NOV10            TVKMLERSSSVSRTEVSNNHVLIYVIKVLTHQTLHFSEFVKQDIQIKKLKPATVKAYDYY     1459
gi|13651966|ref  TVKMLERSSSVSRTEVSNNHVLIYIQVIN-QTLSFSFMVLQDIPVGSLKPAIVKVYDYY     1219
gi|6680608|ref|  SVKRLKDQPNIQRTEVNTNHVLIYEEKINN-QTLGFSFAVEQDIPVKNLKPAPSKVYDYY    1472
gi|1171932|sp|P  SIDQLIDDHTVMQVEYKKNEVLIYIGNILQKRRKEVIESVRQDFVVTHPKPAPVSIYDYY    1451
gi|224053|prf|   TVKMLERSNHVSRTEVSNNHVLIYIDKVSN-QTLSLFFTVLQDIPVRELKPAIVKVYDYY    1429
gi|6678964|ref|  TVKKLERLEHVSRTEVSNNNVLIYIDQVIN-QTLAFSFITIKQDIPVRNLIPAIVKVYDYY   1455

1510       1520
                 ....|....|....|....|
NOV10            ETSDEETFEEYNAPCSAGKV----                                        1479
gi|13651966|ref  ET-DESVVAEYIAPCSTDTEHGNV                                        1242
gi|6680608|ref|  ET-DEETVEEYSAPFSDGSEQGNA                                        1495
gi|1171932|sp|P  ET-KFYAVAEYMSLCRGVVREMG-                                        1473
gi|224053|prf|   ET-DEKATAEYNAPCSKDLGNA--                                        1450
gi|6678964|ref|  ET-DEMAFAEYSSPCSTDKSNV--                                        1476
```

Tables 10E–10F lists the domain description from DOMAIN analysis results against NOV10. This indicates that the NOV10 sequence has properties similar to those of other proteins known to contain this domain.

TABLE 10E

Domain Analysis of NOV10 gnl|Pfam|pfam00207, A2M, Alpha-2-macroglobulin family. This family
includes the C-terminal region of the alpha-2-macroglobulin family.
(SEQ ID NO:115)
CD-Length = 751 residues, 99.9% aligned
Score = 785 bits (2028), Expect = 0.0

```
Query:   730  GPVPETVRSYFPETWIWELVAVSSSGVAEVGVTVPDTITEWKAGAFCLSEDAGLGISSTA   789
              |+|||||+|+||+  |  |  |  |+|+||+||  |+    |    ||    ++
Sbjct:     2  DEDDITIRSYFPESWLWEVEEVDRSPVLTVNITLPDSITTWEILAVSLSNTKGLCVADPV    61

Query:   790  SLRAFQPFFVELTMPYSVIRGEVFTLKATVLNYLP-KCIRVVVQLEVSSAFLAVPTEKNE   848
              |  || ||+|| +|||+|||   |+| +  |||  + ||||  + |+|||||||       +
Sbjct:    62  ELTVFQDFFLELRLPYSVVRGEQVELRAVLYNYLPSQDIKVVVQLEVEP--------LCQ   113

Query:   849  ESHCVCRNGRKTVSWVVTPKSLGNVNFSVSAEAMQSLELCGNEVVEVPEIKRKDTVIKTL   908
              |     |    |  |||| +|+|   +  |    |   |||   || |+|||
Sbjct:   114  AGFCSLATQRTRSSQSVRPKSLSSVSFPVVVVPLASGLSLVEVVASVFEFFVKDAVVKTL   173

Query:   909  LVEPEGIAKEETFNTLPC-----ASGANVSEQLSLKLPSNVVKESARASFSVLGGDILGS   963
              |||||  ||||  ++|      |   |||  +||||  +|    |   ||  ||   +
Sbjct:   174  KVEPEGARKEETVSSLLLPPEHLGGGLEVSEVPALKLPDDVPDTEAEAVISVQ-GDPVAQ   232

Query:   964  AMQN------IQNLLQMPYGCGEQNMVLFAPNIYVLNYLNETQQLTQ---EIKAKAVGYL  1014
              |+||         + |||++| ||||||+  || +||+|+||  |   +   + ||+  +
Sbjct:   233  AIQNTLSGEGLNNLLRLPSGCGEQNMIYMAPTVYVLHYLDETWQWEKPGTKKKQKAIDLI   292

Query:  1015  ITGYQRQLNYKHQDGSYSTFGERYGRNQGNTWLTAFVLKTFAQARSYIFIDEAHITQSLT  1074
              ||||||||+ ||||+ |     +||||||||| |+||+|+||| ||  ++
Sbjct:   293  NKGYQRQLNYRKADGSYAAFLHR----ASSTWLTAFVLKVFSQARNYVFIDEEHICGAVK   348

Query:  1075  WLS-QMQKDNGCFRSSGSLLNNAIKGGVED----EATLSAYVTIALLEIPLPVTNPIVRN  1129
              ||     |||+| || || +++| +||||  |    | |+++||||||    |+|  |
```

TABLE 10E-continued

Domain Analysis of NOV10

```
Sbjct:   349 WLILNQQKDDGVFRESGPVIHNEMKGGVGDDAEVEVTLTAFITIALLEAKLVCISPVVAN    408

Query:  1130 ALFCLESAWNVAKEGTHGSHVYTKALLAYAFSLLGKQNQNREILNSLDKEAVK-DNLVHW   1188
             ||   |+++  + +    +|  |||  ||  |||  +|  |   ++ +|||  || +|    |   ||
Sbjct:   409 ALSILKASDYLLENYANGQRVYTLALTAYALALAGVLHKLKEILKSLKEELYKALVKGHW    468

Query:  1189 ERPQRPKAPVGHLYQTQAPSAEVEMTSYVLLAYLTAQPAPTSGDLTSATNIVKWIMKQQN   1248
             ||||+||    ||  |    |   +|  ||||||  ||| ||   ||          |  +|||+ +||
Sbjct:   469 ERPQKPKDAPGHPYSPQPQAAAVEMTSYALLALLTLLPFPKVE---MAPKVVKWLTEQQY    525

Query:  1249 AQGGFSSTQDTVVALEALSRYGAATFTRTEKTAQVTVQ-DSQTFSTNFQVDNNNLLLLQQ   1307
             |||  ||||||+||  |||+||   ||   ||     ||+|   +|  ++|+|  |||    ||+
Sbjct:   526 YGGGFGSTQDTVMALQALSKYGIATPTHKEKNLSVTIQSPSGSFKSHFQILNNNAFLLRP    585

Query:  1308 ISLPE-LPGEYVITVTGERCVYLQTSMKYNILPEKEDSPFALKVQTVPQTCDGHK-AHTS   1365
             + ||           |||+   +  |  +| +|  +|           |  ||++|||  ||          |  |    |
Sbjct:   586 VELPLNEGFTVTAKVTGQGTLTLVTTYRYKVLDKKNTFCFDLKIETVPDTCVEPKGAKMS    645

Query:  1366 FQISLTISYTGNRPASNMVIVDVKMVSGFIPLKPTVKML--ERSSSVSRTEVSNNHVLIY   1423
             +|+      |  |+|     |   |   |+ |++||||||   +|              ||+  |+    |||+|
Sbjct:   646 DYLSICTRYAGSRSDSGMAIADISMLTGFIPLKPDLKKLENGVDRYVSKYEIDGNHVLLY    705

Query:  1424 VEQVLTHQTLHFSFFVEQDIQIKNLKPATVKAYDYYETSDEFTFEEY 1470
             +++|   +|      | + ||  ++   +|||+||  |||||    ||         |
Sbjct:   706 LDKVSHSETECVGFKIHQDFEVGLLQPASVKVYDYYEP-DEQCTAFY 751
```

TABLE 10F

Domain Analysis of NOV10 gnl|Pfam|pfam01835, A2M_N, Alpha-2-macroglobulin family N-terminal region. This family includes the N-terminal region of the alpha-2-macroglobulin family. (SEQ ID NO:116)
CD-Length = 620 residues, 98.4% aligned
Score = 617 bits (1592), Expect = 1e-177

```
Query:    19 SASDSNSTEPQYMVLVPSLLHTEAPKKGCVLLSHLNETVTVSASLESGRENR---SLFTD     75
                ||+  +|+|||+|||+|   ||  |+|  ||  |   ||||||+   ||  |       |    ||||
Sbjct:    11 LFFDSSLQKPRYMVIVPSILRTETPEKVCVQLHDLNETVTVTVSLHSFPGKRNLSSLFTV     70

Query:    76 LVAEKDLFHCVSFTVPRI----SASSEVAFLSTQIKGPTQDFRKPNTVLVLNTQSLVFVQ    131
             |++ ||||||||||||+        |+   | +|+ +|+|||||     |+++   ||||    + +  |||+|
Sbjct:    71 LLSSKDLFHCVSFTVPQPGLFKSSKGEESFVVVQVKCPTHTFKEKVTVLVSSRRGLVFIQ    130

Query:   132 TDKPMYKPGQTGKVRFRVVSVDENFRPRNELVSLVSLQNPRRNRIAQWQSLKLEAGINQL    191
             ||||+  ||||    ||+||  |||||| ||   ||+ ||  +++     ||+  ||+     ||| || ||
Sbjct:   131 TDKPIYTPGQT--VRYRVFSVDENLRPLNELI-LVYIEDPEGNRVDQWEVNKLEGGIFQL    187

Query:   192 SFPLSSEPIQGSYRVVVQTESGGR--IQHPPTVEEFVLPKFEVKVQVPKIISIMDEKVNI    249
             |||+  |||||+++++|  +  |||        |  |+|+|||  |||    +   ||                |
Sbjct:   188 SFPIPSEPIQGTWKIVARYESGPESNYTHYFEVKEYVLPSFEVSITPPKPFIYYDNFKEF    247

Query:   250 TVCGCYRYTYGEPVPGLVTLSVCRRYSLCRSD----CHNTHSQLNSNG--CITQQVHTKM    303
             |   | |||||+|||+|+ + +      + +       + +       |+ ||   |++|+|   |
Sbjct:   248 EVTICARYTYGKPVPGVAYVRFGVKDEDGKKELLAGLEERAKLLDGNGEICLSQEVLLKE    307

Query:   304 LQITNTGFEMK--LRVEARIREEGTGVEVTANRISEITNIVSKLKFVKVDSHFRQGIPFF    361
             ||+ |   |   |  | |  +|         |+          +|  ||||||  |||+ |||||
Sbjct:   308 LQLKNEDLEGKSLYVAVAVIESEGGDMEEAELGGIKIVRSPYKLKFVKTPSHFKPGIPFF    367

Query:   362 AQVRLVDGKGVPIPNKLFFISVNDANYYSNATTNEQGLAQFSINTTSISVNKLFVRVSYK    421
             +|  +|| | ||    +|   ||+|||| ||+| ||||||||||+  ||     + ||    ++|
Sbjct:   368 LKVLVVDPDGSPAPNVPVKVSAQDASYYSNGTTDEDGLAQFSINTSGISSLSITVRTNHK    427

Query:   422 ESNNCSDNWWLDEFHTQTSHTAKHFFSPSKSYIHLKPIIGTLTCGQTQEIQAHYILNKQI    481
             |         + |+  |   ||  |||||||| | || ||   ||++||    +
Sbjct:   428 ELP------EEVQAHAEAQATAYSTVSLSKSYIHLS-IERTLPCGPGVCEQANPILRGKS    480

Query:   482 LRDEKELTFYYLVKARGKISQSGIHVLSIEQGNSKGSFALSFPVESDVAPIARMFIFAIL    541
             |  + |  ||||+ ++|||  ++|        ||        |+| +|+|  |+  + + ||
Sbjct:   481 LGELKILFPYYLIMSKGKIVKTGREFREPGQGL----FSLSIPVTPDLAPSFRLVAYYIL    536

Query:   542 PDGEVVGDSEKFEIENCLANKVDLSFSPAQS--PPASHAHLQVAAAPQSLCALRAVDQSV    599
             | ||||  ||    ++|+|  |||+|||||++        ||   |+|  |||  ||||||||+|
```

TABLE 10F-continued

Domain Analysis of NOV10

```
Sbjct:  537 PQGEVVADSVWIDVEDCCANKLDLSFSPSKDYRLPAQQVKLRVEADPQSLVALRAVDQAV 596

Query:  600 LLMKPEAELSVSSVYNLLTVKDLT                                     623
            |+||+|+||+|  ||+||    ||
Sbjct:  597 YLLKPKAKLSMSKVYDLLEKSDLG                                     620
```

Pregnancy zone protein (PZP), one of the major pregnancy-associated plasma proteins (see 260100 for another example), was described by Smithies (1959) who used zone-electrophoresis in starch gels. PZP is a prominent constituent of late-pregnancy sera. In healthy, nonpregnant females and in males, PZP is present in trace amounts only: females, 10–30 mg/l; males, less than 10 mg/l. During pregnancy, PZP levels may reach 1000–1400 mg/l just before term. Sottrup-Jensen et al., (1984) showed that PZP closely resembles alpha-2-macroglobulin (103950) in structure. Both have a quaternary structure of 2 covalently bound 180-kD subunits which are further noncovalently assembled into a tetramer of 720 kD. Amino acid sequence of the 2 proteins are extensively homologous. Marynen et al. (1989) used in situ hybridization and somatic cell hybrid DNA analysis to demonstrate that PZP, alpha-2-macroglobulin, and an alpha-2-macroglobulin pseudogene mapped to human chromosome 12p13-p12.2. Although the function of PZP in pregnancy is largely unknown, its close structural relationship to alpha 2M suggests analogous proteinase binding properties and a potential for being taken up in cells by receptor-mediated endocytosis. I The disclosed NOV10 nucleic acid of the invention encoding a Pregnancy Zone Protein Precursor-like protein includes the nucleic acid whose sequence is provided in Table 10A or a fragment thereof. The invention also includes a mutant or variant nucleic acid any of whose bases may be changed from the corresponding base shown in Table 10A while still encoding a protein that maintains its Pregnancy Zone Protein Precursor-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject In the mutant or variant nucleic acids, and their complements, up to about 7 percent of the bases may be so changed.

The disclosed NOV10 protein of the invention includes the Pregnancy Zone Protein Precursor-like protein whose sequence is provided in Table 10B. The invention also includes a mutant or variant protein any of whose residues may be changed from the corresponding residue shown in Table 10B while still encoding a protein that maintains its Pregnancy Zone Protein Precursor-like activities and physiological functions, or a functional fragment thereof. In the mutant or variant protein, up to about 46 percent of the residues may be so changed.

The invention further encompasses antibodies and antibody fragments, such as $F_{ab}$ or $(Fab)_2$, that bind immunospecifically to any of the proteins of the invention.

The above defined information for this invention suggests that this Pregnancy Zone Protein Precursor-like protein (NOV10) may function as a member of a "Pregnancy Zone Protein Precursor family". Therefore, the NOV10 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV10 nucleic acids and proteins of the invention are useful in potential therapeutic applications implicated in pregnancy, hypertensive toxemia, pre-eclampsia/eclampsia (gestational proteinuric hypertension), glomerular endotheliosis, cholestasis, and pruritic urticarial papules and plaques of pregnancy, and/or other pathologies and disorders.

NOV10 nucleic acids and polypeptides are further useful in the generation of antibodies that bind immunospecifically to the novel NOV10 substances for use in therapeutic or diagnostic methods. These antibodies may be generated according to methods known in the art, using prediction from hydrophobicity charts, as described in the "Anti-NOVX Antibodies" section below. The disclosed NOV10 protein has multiple hydrophilic regions, each of which can be used as an immunogen. These novel proteins can be used in assay systems for functional analysis of various human disorders, which will help in understanding of pathology of the disease and development of new drug targets for various disorders.

NOV11

A disclosed NOV11 nucleic acid of 2895 nucleotides (also referred to as SC139725617_A) encoding a novel Transmembrane Receptor UNC5H2-like protein is shown in Table 11A. An open reading frame was identified beginning with an ATG initiation codon at nucleotides 31–33 and ending with a TGA codon at nucleotides 2866–2868. A putative untranslated region upstream from the initiation codon is underlined in Table 11A. The start and stop codons are in bold letters.

TABLE 11A

NOV11 nucleotide sequence (SEQ ID NO:37).

<u>CTCCAGGTCCGCCTGTCCCTGGAATGTTCT</u>ATGCAGGCCAGGGGTTATGGTAGAAATAGCGTCTTGTTGGCC
GGGCTCCTCTGCTGGACCCCTTACCCAGCCTTAGCAGGCACTGATTCTGGCAGCGAGGTGCTCCCTGACTCC
TTCCCGTCAGCGCCAGCAGACCCGCTGCCCTACTTCCTGCAGGAGCCACAGGACGCCTACATTGTGAAGAAC
AAGCCTGTGGAGCTCCGCTGCCGCGCCTTCCCCGCCACACAGATCTACTTCAAGTGCAACGGCGAGTGGGTC
AGCCAGAACGACCACGTCACACAGGAAGGCCTGGATGAGCCCACCGGTCTGCGGGTGCGCGAGGTGCAGATC
GAGGTGTCGCGGCAGCAGGTGGAGGAGCTCTTTGGGCTGGAGGATTACTGGTGCCAGTGCGTGGCCTGGAGC
TCCGCGGGCACCACCAAGAGTCGCCGAGCCTACGTCCGCATCGCCTGTCTGCGCAAGAACTTCGATCAGGAG
CCTCTGGGCAAGGAGGTGCCCCTGGACCATGAGGTTCTCCTGCAGTGCCGCCCGCCGGAGGGGGTGCCTGTG
GCCGAGGTGGAATGGCTCAAGAATGAGGATGTCATCGACCCCACCCAGGACACCAACTTCCTGCTCACCATC
GACCACAACCTCATCATCCGCCAGGCCCGCCTGTCGGACACTGCCAACTATACCTGCGTGGCCAAGAACATC
GTGGCCAAACGCCGGAGCACCACTGCCACCGTCATCGTCTACGTGAATGGCGGCTGGTCCAGCTGGGCAGAG
TGGTCACCCTGCTCCAACCGCTGTGGCCGAGGCTGGCAGAAGCGCACCCGGACCTGCACCAACCCCGCTCCA
CTCAACGGAGGGGCCTTCTGCGAGGGCCAGGCATTCCACAAGACCGCCTQCACCACCATCTGCCCACTCGAT
GGGGCGTGGACGGAGTGGAGCAAGTGGTCAGCCTGCAGCACTGAGTGTGCCCACTGGCGTAGCCGCGAGTGC
ATGGCGCCCCCACCCCAGAACGGAGGCCGTGACTGCAGCGGGACGCTGCTCGACTCTAAGAACTGCACAGAT
GGGCTGTGCATGCAAAGTGAGTCACAGTGTGGTCCTCCTGTCCCCGCAGTGCTGGAGGCCTCAGGGGATGCG
GCGCTGTATGCGGGGCTCGTGGTGGCCATCTTCGTGGTCGTGGCAATCCTCATGGCGGTGGGGGTGGTGGTG
TACCGCCGCAACTGCCGTGACTTCGACACAGACATCACTGACTCATCTGCTGCCCTGACTGGTGGTTTCCAC
CCCGTCAACTTTAAGACGGCAAGGCCCAGTAACCCGCAGCTCCTACACCCCTCTGTGCCTCCTGACCTGACA
GCCAGCGCCGGCATCTACCGCGGACCCGTGTATGCCCTGCAGAACTCCACCGACAAAATCCCCATGACCAAC
TCTCCTCTGCTGGACCCCTTACCCAGCCTTAAGGTCAAGGTCTACAGCTCCAGCACCACGGGCTCTGGGCCA
GGCCTGGCAGATGGGGCTGACCTGCTGGGGGTCTTGCCGCCTGGCACATACCCTAGCGATTTCGCCCCGGAC
ACCCACTTCCTGCACCTGCGCAGCGCCAGCCTCGGTTCCCAGCAGCTCTTGGGCCTGCCCCGAGACCCAGGG
AGCAGCGTCAGCGGCACCTTTGGCTGCCTGGGTGGGAGGCTCAGCATCCCCGGCACAGGTGTCAGCTTGCTG
GTGCCCAATGGAGCCATTCCCCAGGGCAAGTTCTACGAGATGTATCTACTCATCAACAAGGCAGAAAGTACC
CTGCCGCTTTCAGAAGGGACCCAGACAGTATTGAGCCCCTCGGTGACCTGTGGACCCACAGGCCTCCTGCTG
TGCCGCCCCGTCATCCTCACCATGCCCCACTGTGCCGAAGTCAGTGCCCGTGACTGGATCTTTCAGCTCAAG
ACCCAGGCCCACCAGGGCCACTGGGAGGAGGTGGTGACCCTGGATGAGGAGACCCTGAACACACCCTGCTAC
TGCCAGCTGGAGCCCAGGGCCTGTCACATCCTGCTGGACCAGCTGGGCACCTACGTGTTCACGGGCGAGTCC
TATTCCCGCTCAGCAGTCAAGCGGCTCCAGCTGGCCGTCTTCGCCCCCGCCCTCTGCACCTCCCTGGAGTAC
AGCCTCCGGGTCTACTGCCTCGAGGACACGCCTGTAGCACTGAAGGAGGTGCTGGAGCTGGAGCGGACTCTG
GGCGGATACTTGGTGGAGGAGCCGAAACCGCTAATGTTCAAGGACAGTTACCACAACCTGCGCCTCTCCCTC
CATGACCTCCCCCATGCCCATTGGAGGAGCAAGCTGCTGGCCAAATACCAGGAGATCCCCTTCTATCACATT
TGGAGTGGCAGCCAGAAGGCCCTCCACTGCACTTTCACCCTGGAGAGGCACAGCTTGGCCTCCACAGAGCTC
ACCTGCAAGATCTGCGTGCGGCAAGTGGAAGGGGAGGGCCAGATATTCCAGCTGCATACCACTCTGGCAGAG
ACACCTGCTGGCTCCCTGGACACTCTCTGCTCTGCCCCTGGCAGCACTGTCACCACCCAGCTGGGACCTTAT

TABLE 11A-continued

NOV11 nucleotide sequence (SEQ ID NO:37).

GCCTTCAAGATCCCACTGTCCATCCGCCAGAAGATATGCAACAGCCTAGATGCCCCCAACTCACGGGGCAAT

GACTGGCGGATGTTAGCACAGAAGCTCTCTATGGACCGGTACCTGAATTACTTTGCCACCAAAGCGAGCCCC

ACGGGTGTGATCCTGGACCTCTGGGAAGCTCTGCAGCAGGACGATGGGGACCTCAACAGCCTGGCGAGTGCC

TTGGAGGAGATGGGCAAGAGTGAGATGCTGGTGGCTGTGGCCACCGACGGGGACTGCTGAGCCTCCTGGGAC

AGCGGGCTGGCAGGG

In a search of public sequence databases, the NOV11 nucleic acid sequence, located on chromosome 10 has 2425 of 2811 bases (86%) identical to a gb:GENBANK-ID:RNU87306|acc:U87306 mRNA from *Rattus norvegicus* (*Rattus norvegicus*transmembrane receptor Unc5H2 mRNA, complete cds (E=0.0). Public nucleotide databases include all GenBank databases and the GeneSeq patent database.

The disclosed NOV11 polypeptide (SEQ ID NO:38) encoded by SEQ ID NO:37 has 945 amino acid residues and is presented in Table 11B using the one-letter amino acid code. Signal P. Psort and/or Hydropathy results predict that NOV11 has a signal peptide and is likely to be localized in the plasma membrane with a certainty of 0.4600. In other embodiments, NOV11 may also be localized to the endoplasmic reticulum (membrane) with a certainty of 0.1000, the endoplasmic reticulum (lumen) with a certainty of 0.1000, or extracellularly with a certainty of 0.000. The most likely cleavage site for NOV10 is between positions 26 and 27: ALA-GT A search of sequence databases reveals that the NOV11 amino acid sequence has 855 of 945 amino acid residues (90%) identical to, and 892 of 945 amino acid residues (94%) similar to, the 945 amino acid residue ptnr:SPTREM-BLACC:008722 protein from *Rattus norvegicus* (Rat) (transmembrane receptor UNC5H2 (E=9.7e$^{-307}$). Public amino acid databases include the GenBank databases, SwissProt, PDB and PIR.

NOV11 is expressed in at least Epidermis. This information was derived by determining the tissue sources of the sequences that were included in the invention.

In addition, the sequence is predicted to be expressed in brain because of the expression pattern of (GENBANK-ID: RNU87306) a closely related (*Rattus norvegicus*transmembrane receptor UncSH2 mRNA, complete cds homolog.

The disclosed NOV11 polypeptide has homology to the amino acid sequences shown in the BLASTP data listed in Table 11C.

TABLE 11B

Encoded NOV11 protein sequence (SEQ ID NO:38).

MQARGYGRNSVLLAGLLCWTPYPALAGTDSGSEVLPDSFPSAPAEPLPYFLQEPQDAYIVKNKPVELRCRAF

PATQIYFKCNGEWVSQNDHVTQEGLDEATGLRVREVQIEVSRQQVEELFGLEDYWCQCVAWSSAGTTKSRRA

YVRIACLRKTFDQEPLGKEVPLDHEVLLQCRPPEGVPVAEVEWLKNEDVIDPTQDTNFLLTIDHNLIIRQAR

LSDTANYTCVAKNIVAKRRSTTATVIVYVNGGWSSWAEWSPCSNRCGRGWQKRTRTCTNPAPLNGGAFCEGQ

AFQKTACTTICPVDGAWTEWSKWSACSTECAHWRSRECMAPPPQNGGRDCSGTLLDSKNCTDGLCMQSESQC

GPPVPAVLEASGDAALYAGLVVAIFVVVAILMAVGVVVYRRNCRDFDTDITDSSAALTGGFHPVNFKTARPS

NPQLLHPSVPPDLTASAGIYRGPVYALQDSTDKIPMTNSPLLDPLPSLKVKVYSSSTTGSGPGLADGADLLG

VLPPGTYPSDFARDTHFLHLRSASLGSQQLLGLPRDPGSSVSGTFGCLGGRLSIPGTGVSLLVPNGAIPQGK

FYEMYLLINKAESTLPLSEGTQTVLSPSVTCGPTGLLLCRPVILTMPHCAEVSARDWIFQLKTQAHQGHWEE

VVTLDEETLNTPCYCQLEPRACHILLDQLGTYVFTGESYSRSAVKRLQLAVFAPALCTSLEYSLRVYCLEDT

PVALKEVLELERTLGGYLVEEPKPLMFKDSYHNLRLSLHDLPHARWRSKLLAKYQEIPFYHIWSGSQKALHC

TFTLERHSLASTELTCKICVRQVEGEGQIFQLHTTLAETPAGSLDTLCSAPGSTVTTQLGPYAFKIPLSIRQ

KICNSLDAPNSRGNDWRMLAQKLSMDRYLNYFATKASPTGVILDLWEALQQDDGDLNSLASALEEMGKSEML

VAVATDGDC

TABLE 11C

BLAST results for NOV11

| Gene Index/ Identifier | Protein/Organism | Length (aa) | Identity (%) | Positives (%) | Expect |
|---|---|---|---|---|---|
| gi\|6678505\|ref\|NP_033498.1\| (NM_009472) | UNC-5 homolog (C. elegans) 3 [Mus musculus] | 931 | 592/942 (62%) | 694/942 (72%) | 0.0 |
| gi\|3789765\|gb\|AAC67491.1\| (AF055634) | transmembrane receptor UNC5C [Homo sapiens] | 931 | 581/942 (61%) | 690/942 (72%) | 0.0 |
| gi\|16933525\|ref\|NP_003719.2\| (NM_003728) | unc5 (C. elegans homolog) c; homolog of C. elegans transmembrane receptor Unc5 [Homo sapiens] | 931 | 581/942 (61%) | 690/942 (72%) | 0.0 |
| gi\|16159681\|ref\|XP_042940.3\| (XM_042940) | unc5 (C. elegans homolog) c [Homo sapiens] | 931 | 582/942 (61%) | 690/942 (72%) | 0.0 |
| gi\|11559982\|ref\|NP_ (NM_022207) | transmembrane receptor Unc5H2 [Rattus norvegicus] | 945 | 815/945 (86%) | 848/945 (89%) | 0.0 |

The homology between these and other sequences is shown graphically in the ClustalW analysis shown in Table 11D. In the ClustalW alignment of the NOV11 protein, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 11D

ClustalW Analysis of NOV11

1) Novel NOV11 (SEQ ID NO:38)
2) gi|6678505|ref|NP_033498.1| (NM_009472) UNC-5 homolog (C. elegans) 3 [Mus musculus] (SEQ ID NO:117)
3) gi|3789765|gb|AAC67491.1| (AF055634) transmembrane receptor UNC5C [Homo sapiens] (SEQ ID NO:118)
4) gi|16933525|ref|NP_003719.2| (NM_003728) unc5 (C.elegans homolog) c; homolog of C. elegans transmembrane receptor Unc5 [Homo sapiens] [SEQ ID NO:119]
5) gi|16159681|ref|XP_042940.3| (XM_042940) unc5 (C.elegans homolog) c (Homo sapiens) (SEQ ID NO:120)
6) gi|11559982|ref|NP_071543.1| (NM_022207) transmembrane receptor Unc5H2 [Rattus norvegicus] (SEQ ID NO:121)

```
                              10        20        30        40        50        60
                     ....|....|....|....|....|....|....|....|....|....|....|....|
NOV11                MAA---RGYGRNSVLLAGLLCWTPYPALAGTDEGSE-----------VLPRSFPSAPAEP    46
gi|6678505|ref|      MRKGLRATAARCGLGLGYLLQMLVLPALALLSASSTGSAAQDDEFFHELPETFPSDPPEP    60
gi|3789765|gb|A      MRKGLARTAARCGLGLGYLLQMLVLPALALLSASGTGSAAQDDEFFHELPATFPSDPPEP    60
gi|16933525|ref      MRKGLRATAARCGLGLGYLLQMLVLPALALLSASGTGSAAQDDEFFHELPATFPSDPPEP    60
gi|16159681|ref      MRKGLRATAARCGLGLGYLLCMLVLPALALLSASGTGSAAQDDEFFHELPETFPSDPPEP    60
gi|11559982|ref      MRA---RSGARGALLLALLLCWDPTPSLAGEDSGGQ-----------ALPDSFPSAPAEQ    46

70        80        90       100       110       120
                     ....|....|....|....|....|....|....|....|....|....|....|....|
NOV11                LPSFLQEPSDAYIVKNKPVELRCSAFPATQIYFKCNGEWVSQNDHMTQEGMDEASCLRVR   106
gi|6678505|ref|      LPHFLIEPEEAYIVKNKPVNLYCKASPATQIYFKCNSEWVHQKDHWVDERVDETSGLIVR   120
gi|3789765|gb|A      LPHFLIEPEEAYIVKNKPVNLYCKASPATQIYFKCNSEWVHQKDHWVDERVDETSCLIVR   120
gi|16933525|ref      LPHFLIEPEEAYIVKNKPVNLYCKASPATQIYFKCNSEWVHQKDHWVDERVDSTSGLIVR   120
gi|16159681|ref      LPHFLIEPESAYIVKNKPVNLYCKASPATQIYFKCNSEWVHQKDHWVDERVDETSGLIVR   120
gi|11559982|ref      LPHFLREPESAYIVKNKPVELRCSAFPATQIYFKCNGEWVSQKGHNTQESLDEARGLRER   106

130       140       150       160       170       180
                     ....|....|....|....|....|....|....|....|....|....|....|....|
NOV11                EVQIEVSRQQVEELFGLEDYWCQCVAWSSAGTTKSREAYVRIACLRKNEQEPLGKEVPL   166
gi|6678505|ref|      EVSIEISRQQVEELFGPEDYWCQCVAWSSAGTTKSRKAYVRIAYLRKTFEQEPLGKEVSL   180
gi|3789765|gb|A      EVSIEISRQQVEELFGPEDYWCQCVAWSSAGTTKSRKAYVRIAYLRKTFEQEPLGKEVSL   180
gi|16933525|ref      EVSIEISRQQVEELFGPEDYWCQCVAWSSAGTTKSRKAYVRIAYLRKTFEQEPLGKEVSL   180
gi|16159681|ref      EVSIEISRQQVEELFGPEDYWCQCVAWSSAGTTKSRKAYVRIAYLRKTFEQEPLGKEVSL   180
gi|11559982|ref      EVQIEVSRQQVEELFGLEDYWCQCVAWSSSGTTKSREAYSRIAYLRKNFQEPLAKEVPL   166
```

TABLE 11D-continued

ClustalW Analysis of NOV11

```
                190       200       210       220       230       240
                ....|....|....|....|....|....|....|....|....|....|....|....|
NOV11           DHEVLLQCRPPEGYPVAEVEWLKNEDYIDPIQDINFLETIDHKLIIRQARLSDTANYTCV    226
gi|6678505|ref| EQEVLLQCRPPEGIPVAEVEWLKNEDIIDPAEDRNFYITIDHKLIIKQARLSDTANYTCV    240
gi|3789765|gb|A EQEVLLQCRPPEGIPVAEVEWLKNEDIIDPVEDRNFYITIDHNLIIKQARLSDTANYTCV    240
gi|16933525|ref EQEVLLQCRPPEGIPVAEVEWLKNEDIIDPVEDRNFYITIDHNLIIKQARLSDTANYTCV    240
gi|16159681|ref EQEVLLQCRPPEGIPVAEVEWLKNEDIIDPVEDRNFYITIDHNLIIKQARLSDTANYTCV    240
gi|11559982|ref DHEVLLQCRPPEGVPVAEVEWLKNEDYIDPASDINFLETIDHKLIIRQARLSDTANYTCV    226

250       260       270       280       290       300
                ....|....|....|....|....|....|....|....|....|....|....|....|
NOV11           AKNIVAKRESTTATVIVYVNGGWSEWAEWSPCSNRCGRGEQKRTRTCTNPAPLNGGAFCE    286
gi|6678505|ref| AKNIVAKRKSTTATVIVYVNGGWSTWTEWSVCNSRCGRGYQKRTRTCTNPAPLNGGAFCE    300
gi|3789765|gb|A AKNIVAKRKSTTATVIVYVNGGWSTWTEWSVCNSRCGRGYQKRTRTCTNPAPLNGGAFCE    300
gi|16933525|ref AKNIVAKRKSTTATVIVYVNGGWSTWTEWSVCNSRCGRGYQKRTRTCTNPAPLNGGAFCE    300
gi|16159681|ref AKNIVAKRKSTTATVIVYVNGGWSTWTEKSVCNSRCGRGYQKRTRTCTNPAPLNGGAFCE    300
gi|11559982|ref AKNIVAKRESTTATVIVYVNGGWSEWAEWSPCSNRCGRGEQKRTRTCTNPAPLNGGAFCE    286

310       320       330       340       350       360
                ....|....|....|....|....|....|....|....|....|....|....|....|
NOV11           GQEFQKTACTTTCPVDGAWTEWSKWSACSTECAHWRSRECMAPPPQNGGRDCSGTELDSK    346
gi|6678505|ref| GQSVQKIACTTLCPVDGRWTSWSKWSTCGTECTHWRRRECTAPAPKNGGKDCDGLVLQSK    360
gi|3789765|gb|A GQSVQKIACTTLCPVDGRWTPWSKWSTCGTECTHWRRRECTAPAPKNGGKDCDGLVLQSK    360
gi|16933525|ref GQSVQKIACTTLCPVDGRWTPWSKWSTCGTECTHWRRRECTAPAPKNGGKDCDCLVLQSK    360
gi|16159681|ref GQSVQKIACTTLCPVDGRWTPWSKWSTCGTECTHWRRRECTAPAPKNGGKDCDGLVLQSK    360
gi|11559982|ref GQEFQKTACTTYCPVDGAWTEWSKWSACSTECAHWRSRECMAPPPQNGGRDCSGTELDSK    346

370       380       390       400       410       420
                ....|....|....|....|....|....|....|....|....|....|....|....|
NOV11           NCTDGLCMQSESQCGPPVPAVLEASGDAALYAGEVVAEFVVAILNAVGSVVYRENCRDF    406
gi|6678505|ref| NCTDGLCMQAAP-----------DSDDVALYVGIVIAVIVCLAIEVVVALFVYRKNHRDF    409
gi|3789765|gb|A NCTDGLCMQEAP-----------DSDDVALYVGIVIAVIVCLAIEVVVALFVYRKNHRDF    409
gi|16933525|ref NCTDGLCMQEAP-----------DSDDVALYVGIVIAVIVCLAIEVVVALFVYRKNHRDF    409
gi|16159681|ref NCTDGLCMQEAP-----------DSDDVALYVGIVIAVIVCLAIEVVVALFVYRKNHRDF    409
gi|11559982|ref NCTDCLCVLNARTLNDPKSRPLEPSGDVALYAGEVKAVFVVLAYLMAVGSIVYRENCRDF    406

430       440       450       460       470       480
                ....|....|....|....|....|....|....|....|....|....|....|....|
NOV11           EEDIEDSSSALTGGFEPVNFKTARPSNPQLLHPSVPPDLTESAGEYRGPVYALQDSEDKI    466
gi|6678505|ref| ESDIIDS-SALNGGFQPVNIKAARQD-----LLAVPPDLTSAAAMYRGPVYALHDVSDKI    463
gi|3789765|gb|A ESDIIDS-SALNGGFQPVNIKAARQD-----LLAVPPDLTSAAAMYRGPVYALHDVSDKI    463
gi|16933525|ref ESDIIDS-SALNGGFQPVNIKAARQD-----LLAVPPDLTSAAAMYRGPVYALHDVSDKI    463
gi|16159681|ref ESDIIDS-SALNGGFQPVNIKAARQD-----LLAVPPDLTSAAAMYRGPVYALHDVSDKI    463
gi|11559982|ref EEDIEDSSEALTGGFEPVNFKTARPSNPQLLHPSAPPDLTESAGEYRGPVYALQDSEDKI    466

490       500       510       520       530       540
                ....|....|....|....|....|....|....|....|....|....|....|....|
NOV11           PMTNSPELDPLPSLKQKVYESSTTGEGPGLADGAELLGVEPGTYPSDFARETHFLEHLRS    526
gi|6678505|ref| PMTNSPILDPLPNLKIKVYNSS--GAVEPQCDLEFSSKLSPQMTQS--LLENEALELKN    519
gi|3789765|gb|A PMTNSPILDPLPNLKIKVYNSS--GAVSPQDDLSEFSSKLSPQMTQS--LLENEALSLKN    519
gi|16933525|ref PMTNSPILDPLPNLKIKVYNES--GAVSPQDDLSEFSSKLSPQMTQS--LLENEALSLKN    519
gi|16159681|ref PMTNSPILDPLPNLKTKVYNES--GAVSPQDDLSEFSSKLSPQMTQS--LLENEALSLKN    519
gi|11559982|ref PMTNSPELDPLPSLKIKVYESSTIGSGAGLADGAELLGVEPGTYPGDFSRETHFLEHLRS    526

550       560       570       580       590       600
                ....|....|....|....|....|....|....|....|....|....|....|....|
NOV11           ASLGSQQLLGLPRDPGSSVSGEFGCLGGRLSEPGEGVSLLEPNGAIPQQEFYEMYELEES    586
gi|6678505|ref| QSLARQ------TDPSCTAFGEFNSLGGHLIEPNSGVSLLIPAGAIPQGRVYEMYVTVHR    573
gi|3789765|gb|A QSLARQ------TDPSCTAFGSFNSLGGHLIEPNSGVSLLIPAGAIPQGRVYEMYVTVHR    573
gi|16933525|ref QSLARQ------TDPSCTAFGEFNSLGGHLIEPNSGVSLLIPAGAIPQGRVYEMYVTVHR    573
gi|16159681|ref QSLARQ------TDPSCTAFGSFNSLGGHLIEPNSGVSLLIPAGAIPQGRVYEMYVTVHR    573
gi|11559982|ref ASLGSQHLLGLPRDPSSSVSGEFGCLGGRLTEPGEGVSLLEPNGAIPQGEFYEMYERESY    586

610       620       630       640       650       660
                ....|....|....|....|....|....|....|....|....|....|....|....|
NOV11           AEETLPLSEGEQIELSPSVECGPTELLLCRPVILTMPHCASVEARDWIFQLKTQAHQGEW    646
gi|6678505|ref| KENMRPPMEDSQTLLLTPVVSCGPPGALLTRPVILTMHHCADPETEDWKIQLKNQAVQGW    633
gi|3789765|gb|A KEEMRPPMEDSQTLLLTPVVSCCPPGALLTRPVILTMHHCADPETEDWKILLKNQAAQGW    633
gi|16933525|ref KEEMRPPMEDSQTLLLTPVVSCGPPGALLTRPVILTMHHCADPETEDWKILLKNQAAQGW    633
gi|16159681|ref KEEMRPPMEDSQTLLLTPVVSCGPPGALLTRPVILTMHHCADPETEDWKILLKNQAAQGW    633
gi|11559982|ref TEETLPLSEGSQTELSPSVECGPTELLLCRPVILTNPHCASVEAIAGDWIFQLKTQAHQGW    646
```

TABLE 11D-continued

ClustalW Analysis of NOV11

```
                       670        680        690        700        710        720
                  ....|....|....|....|....|....|....|....|....|....|....|....|
NOV11             ERVVTSDEDTLNTPCYCQLRPRACHILLNQLGTYVFTGESYSSSAVKRLSLAYFAPALCR         706
gi|6678505|ref|   EDVVVVGEENFTTPCYIQLDAEACHILTENLSTYALVGQSTIKAAAKRLKLAIFGPLCCS         693
gi|3789765|gb|A   EDVVVVGEENFTTPCYIRLDAEACHILTENLSTYALVGHSTTKAAAKRLKLAIFGPLCCS         693
gi|16933525|ref   EDVVVVGEENFTTPCYIRLDAEACHILTENLSTYALVGHSTTKAAAKRLKLAIFGPLCCS         693
gi|16159681|ref   EDVVVVGEENFTTPCYIQLDAEACHILTENLSTYALVGHSTTKAAAKRLKLAIFGPLCCS         693
gi|11559982|ref   ERVVTSDEETLNTPCYCQLRAKSCHILLEQLGTYVFTGESYSSSAVKRLSLAIFAPALCR         706

730        740        750        760        770        780
                  ....|....|....|....|....|....|....|....|....|....|....|....|
NOV11             SLEYSRRVYCLSDIPVALKEVLELERTLGGYLVEEPKPLVFKDSVHNLRLSRHDSPHAHW         766
gi|6678505|ref|   SLEYSIRVYCLDDTQDALKEVLQLERQMGGQLLEEPKALHFKGSIHNLRLSIHDIAHSLW         753
gi|3789765|gb|A   SLEYSIRVYCLDDTQDALKESLHLERQTGGQLLEEPKALHFKGSIHNLRLSIHDIAHSLW         753
gi|16933525|ref   SLEYSIRVYCLDDTQDALKESLHLERQTGGQLLEEPKALHFKGSIHNLRLSIHDIAHSLW         753
gi|16159681|ref   SLEYSIRVYCLDDTQDALKESLHLERQTGGQLLEEPKALHFKGSIHNLRLSIHDIAHSLW         753
gi|11559982|ref   SLEYSRRVYCLSDTPAALKEVLELERTLGGYLVEEPNTLLFKDSVHNLRLSRHDIPHAHW         766

790        800        810        820        830        840
                  ....|....|....|....|....|....|....|....|....|....|....|....|
NOV11             RSKLLAKYQEIPFYHVWSGSQKALHCTFTLERHSLASTFLTCKRCVRQVEGEGQIFQLET         826
gi|6678505|ref|   KSKLLAKYQEIPFYHRWSCSQRNLHCTFTLERLSLNTVELVCKLCVRQVEGEGQIFQLNC         813
gi|3789765|gb|A   KSKLLAKYQEIPFYHVWSGSQRNLHCTFTLERFSLNTVELVCKLCVRQVEGEGQIFQLNC         813
gi|16933525|ref   KSKLLAKYQEIPFYHVWSGSQRNLHCTFTLERFSLNTVELVCKLCVRQVEGEGQIFQLNC         813
gi|16159681|ref   KSKLLAKYQEIPFYHVWSGSQRNLHCTFTLERFSLNTVELVCKLCVRQVEGEGQIFQLNC         813
gi|11559982|ref   RSKLIAKYQEIPFYHVWNGSQKALHCTFTLERHSLAHTEFTCKVCVRQVEGEGQIFQLNT         826

850        860        870        880        890        900
                  ....|....|....|....|....|....|....|....|....|....|....|....|
NOV11             TKAETPAGSSDTLCSAPGSTNTTQLGPYAFKIPLSIRQKECNSLDAPNSRGNDWRMLAQK         886
gi|6678505|ref|   TVSEEPTG-LDLPLLDPASTITTVTGPSAFSIPLPIRQKLCSSLDAPQTRGHDWRMLAHK         872
gi|3789765|gb|A   TVSEEPTG-IDLPLLDPANTITTVTGPSAFSIPLPIRQKLCSSLDAPQTRGHDWRMLAHK         872
gi|16933525|ref   TVSEEPTG-IDLPLLDPANTITTVTGPSAFSIPLPIRQKLCSSLDAPQTRGHDWRMLAHK         872
gi|16159681|ref   TVSEEPTG-IDLPLLDPANTITTVTGPSAFSIPLPIRQKLCSSLDAPQTRGHDWRMLAHK         872
gi|11559982|ref   TKAETPAGSSDALCSAPGNAATTQLGPYAFKIPLSIRQKECNSLDAPNSRGNDWRELAQK         886

910        920        930        940        950
                  ....|....|....|....|....|....|....|....|....|....|....
NOV11             LSNDRYLNYFATKSSPTGVILDLWEALQQDDGSLNSLASALEEMGSSEMLVAVATEGDC   945
gi|6678505|ref|   LNLDRYLNYFATKSSPTGVILDLWEAQKFPDGNLSMLAAVLEEMGRHETVVSLAAEGQY   931
gi|3789765|gb|A   LNLDRYLNYFATKSSPTGVILDLWEAQKFPDGNLSMLAAVLEEMGRHETVVSLAAEGQY   931
gi|16933525|ref   LNLDRYLNYFATKSSPTGVILDLWEAQKFPDGNLSMLAAVLEEMGRHETVVSLAAEGQY   931
gi|16159681|ref   LNLDRYLNYFATKSSPTGVILDLWEAQKFPDGNLSMLAAVLEEMGRHETVVSLAAEGQY   931
gi|11559982|ref   LSNDRYLNYFATKSSPTGVILDLWEARQQDDGSLNSLASALEEMGSSEMLVATTEGDC   945
```

Tables 1E–M list the domain descriptions from DOMAIN analysis results against NOV11. This indicates that the NOV11 sequence has properties similar to those of other proteins known to contain this domain.

TABLE 11E

Domain Analysis of NOV11 gnl|Smart|smart00218, ZU5, Domain present in ZO-1 and Unc5-like netrin receptors; Domain of unknown function. (SEQ ID NO:122)
CD-Length = 104 residues, 100.0% aligned
Score = 149 bits (376), Expect = 7e-37

```
Query:  541 PGSSVSGTFGCLGGRLSIPGTGVSLLVPNGAIPQGKFYEMYLLINKAESTLPLSEGTQTV 600
                |||||    ||||  |  ||| |++| |||||  |  ||+++   || |   +|+
Sbjct:    1 PSFLVSGTFDARGGRLRGPRTGVRLIIPPGAIPQGTRYTCYLVVHDKLSTPPPLEEGETL  60

Query:  601 LSPSVTCGPTGLLLCRPVILTMPHCAEVSARDWIFQLKTQAHQG                 644
                ||| | ||| | |  |||||  +||||  +   |||     +  |
Sbjct:   61 LSPVVECGPHGALFLRPVILEVPHCASLRPRDWEIVLLRSENGG                 104
```

TABLE 11F

Domain Analysis of NOV11 gnl|Pfam|pfam00791, ZU5, ZU5 domain. Domain present in ZO-1 and Unc5-like netrin receptors Domain of unknown function. (SEQ ID NO:123)

TABLE 11F-continued

Domain Analysis of NOV11

CD-Length = 104 residues, 100.0% aligned
Score = 147 bits (371), Expect = 3e-36

```
Query:   541 PGSSVSGTFGCLGGRLSIPGTGVSLLVPNGAIPQGKFYEMYLLINKAESTLPLSEGTQTV 600
             |  |||||   ||||  | ||| |++| ||||||  |  ||+++  || |   | +|+
Sbjct:     1 SGFLVSGTFDARGGRLRGPRTGVRLIIPPGAIPQGTRYTCYLVVHDKLSTPPPLEEGETL  60

Query:   601 LSPSVTCGPTGLLLCRPVILTMPHCAEVSARDWIFQLKTQAHQG                 644
             ||| | |||  | | | |||||+||||  + |||  |    + |
Sbjct:    61 LSPVVECGPHGALFLRPVILEVPHCASLRPRDWELVLLRSENGG                 104
```

TABLE 11G

Domain Analysis of NOV11 gnl|Smart|smart00005, DEATH, DEATH domain, found in proteins involved
in cell death (apoptosis).; Alpha-helical domain present in a variety
of proteins with apoptotic functions. Some (but not all) of these
domains form homotypic and heterotypic dimers. (SEQ ID NO:124)
CD-Length = 96 residues, 99.0% aligned
Score = 64.7 bits (156), Expect = 2e-11

```
Query:   852 GPYAFKIPLSIRQKICNSLDAPNSRGNDWRMLAQKLSM-DRYLNYFATKAS-----PTGV 905
             | |  +   |+|+   ||  +  +|||  ||+||  + ++     |++         +
Sbjct:     1 PPGAASLTELTREKLAKLLD--HDLGDDWRELARKLGLSEADIDQIETESPRDLAEQSYQ  58

Query:   906 ILDLWEALQQDDGDLNSLASALEEMGKSEMLVAVATD                        942
             +|  |||   +  +  | ||  +||+  +  + ++
Sbjct:    59 LLRLWEQREGKNATLGTLLEALRKMGRDDAVELLRSE                         95
```

TABLE 11H

Domain Analysis of NOV11 gnl|smart|smart00209, TSP1, Thronbospondin type 1 repeats; Type 1
repeats in thrombospondin-1 bind and activate TGF-beta.
(SEQ ID NO: 125)
CD-Length = 51 residues, 100.0% aligned
Score = 62.4 bits (150), Expect = 1e-10

```
Query:   249 WSSWAEWSPCSNRCGRGWQKRTRTCTNPAPLNgGAFCEGQAFQKTACTT-ICP 300
             |  |+||||||  ||||  ||| |  ||| |   ||     |||  +  || || ||
Sbjct:     1 WGEWSEWSPCSVTCGGGVQTRTRCCNPPP--NGGGPCTGPDTETRACNEQPCP  51
```

TABLE 11I

Domain Analysis of NOV11 gnl|Smart|smart00209, TSP1, Thrombospondin type 1 repeats; Type 1
repeats in thrombospondin-1 bind and activate TGF-beta.
(SEQ ID NO:125)
CD-Length = 51 residues, 98.0% aligned
Score = 49.3 bits (116), Expect 1e-05

```
Query:   305 WTEWSKWSACSTECAH-WRSRECMAPPPQNGGRDCSGTLLDSKNCTDGLC 353
             | |||+|| ||  |   ++|    || ||| |+|  +++ | +  |
Sbjct:     1 WGEWSEWSPCSVTCGGGVQTRTRCCNPPPNGGGPCTGPDTETRACNEQPC  50
```

TABLE 11J

Domain Analysis of NOV11 gnl|Pfam|pfam00531, death, Death domain. (SEQ ID NQ:126)
CD-Length = 83 residues, 98.8% aligned
Score = 59.7 bits (143), Expect = 7e-10

```
Query:   864 QKICNSLDAPNSRGNDWRMLAQKLSM-DRYLNYFATKA----SPTGVILDLWEALQQDDG 918
                +++|  || |   |  ||| ||+|| + ++       +    |||  +|||| +
```

TABLE 11J-continued

Domain Analysis of NOV11

```
Sbjct:    1 RELCKLLDDP--LGrdWRRLARKLGLSEEEIDQIEHENPRLASPTYQLLDLWEQRGGKNA  58

Query:  919 DLNSLASALEEMGKSEMLVAVATD                                     942
            + +|   | | +||+ + +  + +
Sbjct:   59 TVGTLLEALRKMGRDDAVELLESA                                      82
```

TABLE 11K

Domain Analysis of NOV11

```
gnl|Pfam|pfam00090, tsp_1, Thrombospondin type 1
domain. (SEQ ID NO: 127)
CD-Length = 48 residues, 91.7% aligned
Score = 49.3 bits (116), Expect = 1e-06

Query:  250 SSWAEWSPCSNRCGRGWQKRTRTCTNPAPLNGGAFCEGQAFQKTACT 296
            | |+||||||  ||+| + |  ||| +||   ||  | | | + ||
Sbjct:    1 SPWSEWSPCSVTCGKGIRTEQRTCNSPA---GGKPCTGDAQETEACM   44
```

TABLE 11L

Domain Analysis of NOV11

```
gnl|Pfam|pfam00090, tsp_1, Thrombospondin type 1 domain.
(SEQ ID NO:127)
CD-Length = 48 residues, 100.0% aligned
Score = 36.2 bits (82), Expect = 0.009

Query:  306 TEWSKWSACSTEC---AHWRSRECMAPPPQNGGRDCSGTLLDSKNCTDGLC 353
            +  ||+|| ||  |          | | | +|   ||+ |+|   +++ |     |
Sbjct:    1 SPWSEWSPCSVTCGKGIRTRQRTCNSPA---GGKPCTGDAQETEACMNDPC  48
```

TABLE 11M

Domain Analysis of NOV11

```
gnl|Smart|smart00408, IGc2, Immunoglobulin C-2 Type (SEQ ID NO:128)
CD-Length = 63 residues, 87.3% aligned
Score = 42.7 bits (99), Expect = 9e-05

Query:  170 VLLQCRPPEGVPVAEVEWLKNEDVIDPTQDTNFLLTIDHNLIIRQARLSDTANYTCVAKN 229
            |  |  |  |   |  ||  + |||+    +  ++       ++        |  |+     |  |+  ||||+|
Sbjct:    6 VTLTC-PASGDPVPNITWLKDGKPLPESR----VVASGSTLTIKNVSLEDSGLYTCVARN  60
```

PMID: 10908620, UT: 20370928 Netrin-1 promotes thalamic axon growth and is required for proper development of the thalamocortical projection. Braisted J E, Catalano S M, Stimac R, Kennedy T E, Tessier-Lavigne M, Shatz C J, O'Leary D D Molecular Neurobiology Laboratory, The Salk Institute, La Jolla, Calif. 92037, USA.

The thalamocortical axon (TCA) projection originates in dorsal thalamus, conveys sensory input to the neocortex, and has a critical role in cortical development. We show that the secreted axon guidance molecule netrin-1 acts in vitro as an attractant and growth promoter for dorsal thalamic axons and is required for the proper development of the TCA projection in vivo. As TCAs approach the hypothalamus, they turn laterally into the ventral telencephalon and extend toward the cortex through a population of netrin-1-expressing cells. DCC and neogenin, receptors implicated in mediating the attractant effects of netrin-1, are expressed in dorsal thalamus, whereas unc5h2 and unc5h3, netrin-1 receptors implicated in repulsion, are not. In vitro, dorsal thalamic axons show biased growth toward a source of netrin-1, which can be abolished by netrin-1-blocking antibodies. Netrin-1 also enhances overall axon outgrowth from explants of dorsal thalamus. The biased growth of dorsal thalamic axons toward the internal capsule zone of ventral telencephalic explants is attenuated, but not significantly, by netrin-1-blocking antibodies, suggesting that it releases another attractant activity for TCAs in addition to netrin-1. Analyses of netrin-1–/– mice reveal that the TCA projection through the ventral telencephalon is disorganized, their pathway is abnormally restricted, and fewer dorsal thalamic axons reach cortex. These findings demonstrate that netrin-1 promotes the growth of TCAs through the ventral telencephalon and cooperates with other guidance cues to control their path finding from dorsal thalamus to cortex.

PMID: 10366627, UI: 99296863 Netrin-3, a mouse homolog of human NTN2L, is highly expressed in sensory ganglia and shows differential binding to netrin receptors. Wang H, Copeland N G, Gilbert D J, Jenkins N A, Tessier-Lavigne M Departments of Anatomy, and Biochemistry and Biophysics, Howard Hughes Medical Institute, University of California, San Francisco, Calif. 94143-0452, USA.

The netrins comprise a small phylogenetically conserved family of guidance cues important for guiding particular axonal growth cones to their targets. Two netrin genes, netrin-1 and netrin-2, have been described in chicken, but in mouse so far a single netrin gene, an ortholog of chick netrin-1, has been reported. We report the identification of a second mouse netrin gene, which we name netrin-3. Netrin-3 does not appear to be the ortholog of chick netrin-2 but is the ortholog of a recently identified human netrin gene termed NTN2L ("netrin-2-like"), as evidenced by a high degree of sequence conservation and by chromosomal localization. Netrin-3 is expressed in sensory ganglia, mesenchymal cells, and muscles during the time of peripheral nerve development but is largely excluded from the CNS at early stages of its development. The murine netrin-3 protein binds to netrin receptors of the DCC (deleted in colorectal cancer) family [DCC and neogenin] and the UNC5 family (UNC5H1, UNC5H2 and UNC5H3). Unlike chick netrin-1, however, murine netrin-3 binds to DCC with lower affinity than to the other four receptors. Consistent with this finding, although murine netrin-3 can mimic the outgrowth-promoting activity of netrin-1 on commissural axons, it has lower specific activity than netrin-1. Thus, like netrin-1, netrin-3 may also function in axon guidance during development but may function predominantly in the development of the peripheral nervous system and may act primarily through netrin receptors other than DCC.

PMID: 10399920, UI: 99325507 A ligand-gated association between cytoplasmic domains of UNC5 and DCC family receptors converts netrin-induced growth cone attraction to repulsion. Hong K, Hinck L, Nishiyama M, Poo MM, Tessier-Lavigne M, Stein E Department of Biology, University of California, San Diego, 92093, USA.

Netrins are bifunctional: they attract some axons and repel others. Netrin receptors of the Deleted in Colorectal Cancer (DCC) family are implicated in attraction and those of the UNC5 family in repulsion, but genetic evidence also suggests involvement of the DCC protein UNC40 in some cases of repulsion. To test whether these proteins form a receptor complex for repulsion, we studied the attractive responses of *Xenopus* spinal axons to netrin-1, which are mediated by DCC. We show that attraction is converted to repulsion by expression of UNC5 proteins in these cells, that this repulsion requires DCC function, that the UNC5 cytoplasmic domain is sufficient to effect the conversion, and that repulsion can be initiated by netrin-1 binding to either UNC5 or DCC. The isolated cytoplasmic domains of DCC and UNC5 proteins interact directly, but this interaction is repressed in the context of the full-length proteins. We provide evidence that netrin-1 triggers the formation of a receptor complex of DCC and UNC5 proteins and simultaneously derepresses the interaction between their cytoplasmic domains, thereby converting DCC-mediated attraction to UNC5/DCC-mediated repulsion.

PMID: 10341242, UI: 99274743 Floor plate and netrin-1 are involved in the migration and survival of inferior olivary neurons. Bloch-Gallego E, Ezan F, Tessier-Lavigne M, Sotelo C Institut National de la Sante et de la Recherche Medicale U106, Hopital de la Salpetriere, 75013 Paris, France.

During their circumferential migration, the nuclei of inferior olivary neurons translocate within their axons until they reach the floor plate where they stop, although their axons have already crossed the midline to project to the contralateral cerebellum. Signals released by the floor plate, including netrin1, have been implicated in promoting axonal growth and chemoattraction during axonal pathfinding in different midline crossing systems. In the present study, we report experiments that strongly suggest that the floor plate could also be involved in the migration of inferior olivary neurons. First, we show that the pattern of expression of netrin receptors DCC (for deleted in colorectal cancer), neogenin (a DCC-related protein), and members of the Unc5 family in wild-type mice is consistent with a possible role of netrins in directing the migration of precerebellar neurons from the rhombic lips. Second, we have studied mice deficient in netrin-I production. In these mice, the number of inferior olivary neurons is remarkably decreased. Some of them are located ectopically along the migration stream, whereas the others are located medioventrally and form an atrophic inferior olivary complex: most subnuclei are missing. However, axons of the remaining olivary cell bodies located in the vicinity of the floor plate still succeed in entering their target, the cerebellum, but they establish an ipsilateral projection instead of the normal contralateral projection. In vitro experiments involving ablations of the midline show a fusion of the two olivary masses normally located on either side of the ventral midline, suggesting that the floor plate may function as a specific stop signal for inferior olivary neurons. These results establish a requirement for netrin-1 in the migration of inferior olivary neurons and suggest that it may function as a specific guidance cue for the initial steps of the migration from the rhombic lips and then later in the development of the normal crossed projection of the inferior olivary neurons. They also establish a requirement for netrin-1, either directly or indirectly, for the survival of inferior olivary neurons.

PMID: 9126742 Vertebrate homologues of *C. elegans* UNC-5 are candidate netrin receptors. Leonardo E D, Hinck L, Masu M, Keino-Masu K, Ackerman S L, Tessier-Lavigne M Howard Hughes Medical Institute, Department of Anatomy, Programs in Cell and Developmental Biology and Neuroscience, University of California, San Francisco 94143-0452, USA.

In the developing nervous system, migrating cells and axons are guided to their targets by cues in the extracellular environment. The netrins are a family of phylogenetically conserved guidance cues that can function as diffusible attractants and repellents for different classes of cells and axons. In vertebrates, insects and nematodes, members of the DCC subfamily of the immunoglobulin superfamily have been implicated as receptors that are involved in migration towards netrin sources. The mechanisms that direct migration away from netrin sources (presumed repulsions) are less well understood. In *Caenorhabditis elegans*, the transmembrane protein UNC-5 (ref. 14) has been implicated in these responses, as loss of unc-5 function causes migration defects and ectopic expression of unc-5 in some neurons can redirect their axons away from a netrin source. Whether UNC-5 is a netrin receptor or simply an accessory to such a receptor has not, however, been defined. We now report the identification of two vertebrate homologues of UNC-5 which, with UNC-5 and the product of the mouse rostral cerebellar malformation gene (rcm), define a new subfamily of the immunoglobulin superfamily, and whose messenger RNAs show prominent expression in various classes of differentiating neurons. We provide evidence that these two UNC-5 homologues, as well as the rcm gene product, are netrin-binding proteins, supporting the hypothesis that UNC-5 and its relatives are netrin receptors.

The disclosed NOV11 nucleic acid of the invention encoding a Transmembrane Receptor UNC5H2-like protein includes the nucleic acid whose sequence is provided in Table 11A or a fragment thereof. The invention also includes a mutant or variant nucleic acid any of whose bases may be changed from the corresponding base shown in Table 11A while still encoding a protein that maintains its Transmembrane Receptor UNC5H2-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 14 percent of the bases may be so changed.

The disclosed NOV11 protein of the invention includes the Transmembrane Receptor UNC5H2-like protein whose sequence is provided in Table 11B. The invention also includes a mutant or variant protein any of whose residues may be changed from the corresponding residue shown in Table 11B while still encoding a protein that maintains its Transmembrane Receptor UNC5H2-like activities and physiological functions, or a functional fragment thereof. In the mutant or variant protein, up to about 39 percent of the residues may be so changed.

The invention further encompasses antibodies and antibody fragments, such as $F_{ab}$ or $(F_{ab})_2$, that bind immunospecifically to any of the proteins of the invention.

The above defined information for this invention suggests that this Transmembrane Receptor UNC5H2-like protein (NOV11) may function as a member of a "Transmembrane Receptor UNC5H2 family". Therefore, the NOV11 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV11 nucleic acids and proteins of the invention are useful in potential therapeutic applications implicated in various diseases and pathologies.

NOV11 nucleic acids and polypeptides are further useful in the generation of antibodies that bind immunospecifically to the novel NOV11 substances for use in therapeutic or diagnostic methods. These antibodies may be generated according to methods known in the art, using prediction from hydrophobicity charts, as described in the "Anti-NOVX Antibodies" section below. The disclosed NOV11 protein has multiple hydrophilic regions, each of which can be used as an immunogen. These novel proteins can be used in assay systems for functional analysis of various human disorders, which will help in understanding of pathology of the disease and development of new drug targets for various disorders.

NOV12

A disclosed NOV12 nucleic acid of 192 nucleotides (also referred to as Curagen Accession No. SC134999661_A) encoding a novel Thymosin-like protein is shown in Table 12A. An open reading frame was identified beginning with an ATG initiation codon at nucleotides 31–33 and ending with a TAA codon at nucleotides 175–177. Putative untranslated regions upstream from the initiation codon and downstream of the termination codon are underlined in Table 12A. The start and stop codons are in bold letters.

TABLE 12A

NOV12 nucleotide sequence (SEQ ID NO:39).

<u>TTTTTCTTTTCAGGCTTTCTTCTAGTCAAG</u>ATGAGTGATAAACCAGACTTGTCGGAAGTGGAGAAGTTTGAC
AGGTCAAAACTGAAGAAAACTAATACTGAAGAAAAAAATACTCTTCCCTCAAAGGAAAGTAAGTCATGTGGG
GTTCTACTGGAAACAAACAATAGAGGAAGTTAA<u>TAGGTTCAGTAAATA</u>

In a search of public sequence databases, the NOV12 nucleic acid sequence, localized to the X chromosome, has 192 of 192 bases (100%) identical to a gb:GENBANK-ID:HSV362H12|acc:Z70227 mRNA from *Homo sapiens* (E=2.8e$^{-36}$). Public nucleotide databases include all GenBank databases and the GeneSeq patent database.

The disclosed NOV12 polypeptide (SEQ ID NO:40) encoded by SEQ ID NO:39 has 48 amino acid residues and is presented in Table 12B using the one-letter amino acid code. Signal P, Psort and/or Hydropathy results predict that NOV112 has no signal peptide and is likely to be localized to the nucleus with a certainty of 0.5392. In other embodiments, NOV12 may also be localized to the microbody (peroxisome) with acertainty of 0.3000, the mitochondrial membrane space with a certainty of 0.1000, or to the lysosome (lumen) with a certainty of 0.1000.

TABLE 12B

Encoded NOV12 protein sequence (SEQ ID NO:40).

MSDKPDLSEVEKFDRSKLKKTNTEEKNTLPSKESKSCGVLLETNNRGS

A search of sequence databases reveals that the NOV12 amino acid sequence has 33 of 34 amino acid residues (97%) identical to, and 34 of 34 amino acid residues (100%) similar to, the 45 amino acid residue ptnr:pir-id:JC5274 protein from human thymosin beta (E=1.6e$^{-12}$). Public amino acid databases include the GenBank databases, SwissProt, PDB and PIR.

NOV12 is expressed in at least the following tissues: Brain, Foreskin, Heart, Kidney, Lung, Mammary gland/Breast, Muscle, Parathyroid Gland, Peripheral Blood, Prostate, Testis, Uterus. This information was derived by determining the tissue sources of the sequences that were included in the invention. In addition, the sequence is predicted to be expressed in Brain, Breast, and Prostate because of the expression pattern of (GENBANK-ID: HSV362H12) a closely related {Human DNA sequence from cosmid V362H12, between markers DXS366 and DXS87 on chromosome X homolog.

The disclosed NOV12a polypeptide has homology to the amino acid sequences shown in the BLASTP data listed in Table 12C.

TABLE 12C

BLAST results for NOV12a

| Gene Index/ Identifier | Protein/ Organism | Length (aa) | Identity (%) | Positives (%) | Expect |
|---|---|---|---|---|---|
| gi\|2143995\|pir\|\|I52084 | thymosin beta-4 precursor - rat (fragment) | 56 | 16/34 (47%) | 21/34 (61%) | 6.4 |

The homology between these and other sequences is shown graphically in the ClustalW analysis shown in Table 12D. In the ClustalW alignment of the NOV12 protein, as well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 12D

ClustalW Analysis of NOV12

1) Novel NOV12 (SEQ ID NO:40)
9) gi|2143995|pir||I52084 thymosin beta-4 precursor rat (fragment) (SEQ ID NO:129)

```
------------MSDKPDLSEVEKFDRSKLKKTNTEEKNTLPSKESKSCGVLLETNNRGS
LFAQLAQLLPATMSDKPDMAEIEKFDKSKLKKTETQEKNPLPSKET----IEQEKQAGES
```

Thymosin beta-4 is a small polypeptide whose exact physiological role is not yet known [1]. It was first isolated as a thymic hormone that induces terminal deoxynucleotidyltransferase. It is found in high quantity in thymus and spleen but is widely distributed in many tissues. It has also been shown to bind to actin monomers and thus to inhibit actin polymerization [2].•function: exact physiological role is not yet known, thymic hormone that induces terminal deoxynucleotidyltransferase, can bind to actin monomers and thus to inhibit actin polymerization.•function: hematopoietic system regulatory peptide has inhibitory activity on the proliferation of hematopoeitic pluripotent stem cells.•subcellular location: cytoplasmic.•tissue specificity: originally found in thymus Out it is widely distributed in many tissues.•induction: by alpha-interferon, nerve and fibroblast growth factors.•similarity: belongs to the thymosin beta family. Blocks protein family: BL00500 Thymosin beta-4 family proteins.

PMID: 2325669, UI: 90220652 Thymosin beta 4 is expressed in ROS 17/2.8 osteosarcoma cells in a regulated manner. Atkinson M J, Freeman M W, Kronenberg H M Endocrine Unit, Massachusetts General Hospital, Boston.

The differential expression of mRNAs between the closely related rat osteosarcoma cell lines ROS 17/2.8 and ROS 25/1 was used to identify genes whose expression is associated with the osteoblast phenotype. Thymosin beta 4 cDNA was cloned from an ROS 17/2.8 complimentary DAN library on the basis of its differential hybridization with radiolabeled cDNA prepared from ROS 17/2.8 and ROS 25/1 cells. Northern blot analysis confirmed that thymosin beta 4, hitherto a putative immunodulatory hormone, was indeed differentially expressed. Steady state mRNA levels were severalfold higher in ROS 17/2.8 cells exhibiting an osteoblast-like phenotype, compared with the less osteoblast-like ROS 25/1. Thymosin beta 4 transcripts were also detected in rat UMR 106 osteosarcoma cells and in intact neonatal and fetal rat calvaria. Sequence analysis of the cDNA indicated that thymosin beta 4 transcripts may arise by processing at a more distal polyadenylation signal. Treatment of ROS 17/2.8 cells with dexamethasone increased, while addition of 1,25-dihydroxyvitamin D3 decreased thymosin beta 4 mRNA. The phenotype-dependent expression in the ROS cells and the response to steroid hormone suggest that thymosin beta 4 expression contributes to the osteoblast phenotype.

PMID: 10777749, UI: 20241883 De La Cruz E M, Ostap E M, Brundage R A, Reddy K S, Sweeney H L, Safer D Pennsylvania Muscle Institute and Department of Physiology, University of Pennsylvania School of Medicine, Philadelphia, Pa. 19104 USA. enriguem@mail.med.upenn.edu Thymosin-beta(4) (T-beta(4)) binds actin monomers stoichiometrically and maintains the bulk of the actin monomer pool in metazoan cells. Theta(4) binding quenches the fluorescence of N-iodoacetyl-N'-(5-sulfo-1-naphthyl) ethylenediamine (AEDANS) conjugated to Cys(374) of actin monomers. The K(d) of the actin-Theta(4) complex depends on the cation and nucleotide bound to actin but is not affected by the AEDANS probe. The different stabilities are determined primarily by the rates of dissociation. At 25 degrees C., the free energy of Theta(4) binding MgATP-actin is primarily enthalpic in origin but entropic for CaATP-actin. Binding is coupled to the dissociation of bound water molecules, which is greater for CaATP-actin than MgATP-actin monomers. Proteolysis of MgATP-actin, but not CaATP-actin, at Gly(46) on subdomain 2 is >12 times faster when Tbeta(4) is bound. The C terminus of Tbeta(4) contacts actin near this cleavage site, at His(40). By tritium exchange, Theta(4) slows the exchange rate of approximately eight rapidly exchanging amide protons on actin. We conclude that Theta(4) changes the conformation and structural dynamics ("breathing") of actin monomers. The conformational change may reflect the unique ability of Tbeta (4) to sequester actin monomers and inhibit nucleotide exchange.

PMID: 10581087, UI: 20048164 Young J D, Lawrence A J, MacLean A G, Leung B P, MeInnes I B, Canas B, Pappin D J, Stevenson R D Division of Infection and Immunity, Institute of Biomedical and Life Sciences, University of Glasgow, Glasgow, G 12 8QQ, UK.

The possibility that glucocorticoids upregulate the expression of anti-inflammatory mediators is an exciting prospect for therapy in inflammatory diseases, because these molecules could give the therapeutic benefits of steroids without toxic side effects. Supernatants from monocytes and macrophages cultured in the presence of glucocorticoids increase the dispersion of neutrophils from a cell pellet in the capillary tube migration assay. This supernatant factor, unlike other neutrophil agonists, promotes dispersive locomotion of neutrophils at uniform concentration, lowers their adhesion to endothelial cells, inhibits their chemotactic response to FMLP and induces distinctive morphological changes. Here we show that thymosin beta4 sulfoxide is generated by monocytes in the presence of glucocorticoids and acts as a signal to inhibit an inflammatory response. In vitro, thymosin beta4 sulfoxide inhibited neutrophil chemotaxis, and in vivo, the oxidized peptide, but not the native form, was a potent inhibitor of carrageenin-induced edema in the mouse paw. Thymosin beta4 is unique, because oxidation attenuates its intracellular G-actin sequestering activity, but greatly enhances its extracellular signaling properties. This description of methionine oxidation conferring extracellular function on a cytosolic protein may have far-reaching implications for future strategies of anti-inflammatory therapy.

PMID: 10469335, UI: 99398473 Malinda K M, Sidhu G S, Mani H, Banaudha K, Maheshwari R K, Goldstein A L, Kleinman R K Craniofacial Developmental Biology and Regeneration Branch, National Institute of Dental and Craniofacial Research, NIH, Bethesda, Md. 208924370, USA.

Angiogenesis is an essential step in the repair process that occurs after injury. In this study, we investigated whether the angiogenic thymic peptide thymosin beta4 (Tbeta4) enhanced wound healing in a rat full thickness wound model. Addition of Tbeta4 topically or intraperitoneally increased reepithelialization by 42% over saline controls at 4 d and by as much as 61% at 7 d post-wounding. Treated wounds also contracted at least 11% more than controls by day 7. Increased collagen deposition and angiogenesis were observed in the treated wounds. We also found that Tbeta4 stimulated keratinocyte migration in the Boyden chamber assay. After 4–5 h, migration was stimulated 2–3-fold over migration with medium alone when as little as 10 pg of Tbeta4 was added to the assay. These results suggest that Tbeta4 is a potent wound healing factor with multiple activities that may be useful in the clinic.

The disclosed NOV12 nucleic acid of the invention encoding a Thymosin-like protein includes the nucleic acid whose sequence is provided in Table 12A or a fragment thereof. The invention also includes a mutant or variant nucleic acid any of whose bases may be changed from the corresponding base shown in Table 12A while still encoding a protein that maintains its Thymosin-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 10 percent of the bases may be so changed.

The disclosed NOV12 protein of the invention includes the Thymosin-like protein whose sequence is provided in Table 12B. The invention also includes a mutant or variant protein any of whose residues may be changed from the corresponding residue shown in Table 12B while still encoding a protein that maintains its Thymosin-like activities and physiological functions, or a functional fragment thereof. In the mutant or variant protein, up to about 53 percent of the residues may be so changed.

The invention further encompasses antibodies and antibody fragments, such as $F_{ab}$ or $(F_{ab})_2$, that bind immunospecifically to any of the proteins of the invention.

The above defined information for this invention suggests that this Thymosin-like protein (NOV12) may function as a member of a "Thymosin family". Therefore, the NOV12 nucleic acids and proteins identified here may be useful in potential therapeutic applications implicated in (but not limited to) various pathologies and disorders. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV12 nucleic acids and proteins of the invention are useful in potential therapeutic applications implicated in various pathologies and disorders.

NOV12 nucleic acids and polypeptides are further useful in the generation of antibodies that bind immunospecifically to the novel NOV12 substances for use in therapeutic or diagnostic methods. These antibodies may be generated according to methods known in the art, using prediction from hydrophobicity charts, as described in the "Anti-NOVX Antibodies" section below. These novel proteins can be used in assay systems for functional analysis of various human disorders, which will help in understanding of pathology of the disease and development of new drug targets for various disorders.

NOV13

A disclosed NOV13 nucleic acid of 594 nucleotides (also referred to as Curagen Accession No. AC025256_da7) encoding a novel neuromodulin-like protein is shown in Table 13A. An open reading frame was identified beginning with an ATG initiation codon at nucleotides 193–195 and ending with a TAA codon at nucleotides 535–537. The untranslated regions are underlined and the start and stop codons are in bold letters in Table 13A.

TABLE 13A

NOV13 nucleotide sequence (SEQ ID NO:41).

CTGGGTTTTGGCGGCCGATCAGGCGCAGCCGGTGTACCTGCGTGACCAGGTCGCCACGCCGAAAGCACCGCC

GCCATGACAACTGGTCGGATGCTTGGCGTCAGGATTCCTTCGGCATTTGCCAAGGACGCAGCCCGCCGCTAC

ATTGCCAGCACTGTCCCTTGTTCAGCCGAGCCCACCGAGCAGTCCTAGATGCGGATCGACGGTTACCTACCT

TABLE 13A-continued

NOV13 nucleotide sequence (SEQ ID NO:41).

TCCTACTCGCCAGATCGTGGCCCCCGTTCGGGGACTGCGGTCACGCCCTATCGAGAGGCGCAGCGGGAGGTC

GAGGCTCAGCGTGAACAGCCGGCTGCCCCAGCCAGCAGCCAGGGGCTGGAGCAGGCGCCGCAGATTCGCCGC

GTGCAGGCCAGCAGCAGTAACACCGATAGCCTGCCGACCCGCTCGCAGGACCTCGGTTATCAACAACCTACG

TTGAGCAACCGTGCCGCTCAGGCGTTGGCCAGCTACAGCACCACCGCCGCTTACGCCAGCGAGTACGATGCG

CAGGAAGTGCTCGGCCTCGATCTCTACGCGTAACCCCGTTTCACGGCGTGGGTCAGCCCCTCAGCTGGACCG

TCGCATAGATCGATGAGC

In a search of public sequence databases, the NOV13 nucleic acid sequence, located on the q13 region of chromosome 12, has 126 of 204 bases (61%) identical to a gb:GENBANK-D:AF072132|acc:AF072132.1 mRNA from *Pseudomonas aeruginosa* Hypothetical 12.1 Kda Protein (E=0.0073). Public nucleotide databases include all GenBank databases and the GeneSeq patent database.

The disclosed NOV113 polypeptide (SEQ ID NO 42) encoded by SEQ ID NO:41 has 114 amino acid residues and is presented in Table 13B using the one-letter amino acid code. Signal P, Psort and/or Hydropathy results predict that NOV13 has no signal peptide and is likely to be localized in the cytoplasm with a certainty of 0.6500.

processes including gene transcription. It is the purpose of this review to examine the behavior of neuromodulin, neurogranin, and PEP-19 in paradigms that include both in vitro and in situ systems in order to summarize possible biological consequences that are linked to the expression of this type of protein. The use of protein:protein interaction chromatography is also examined in the, recovery of a new calmodulin-binding peptide, CAP-19 (ratMBF1). Consistent with earlier predictions, at least one function of small IQ-motif proteins appears to be that they lessen the extent to which calcium-calmodulin-dependent enzymes become or stay activated. It also appears that these polypeptides can function to selectively inhibit activation of intracellular

TABLE 13B

Encoded NOV13 protein sequence (SEQ ID NO:42).

MRIDGYLPSYSPDRGPRSGTAVTPYREAQREVEAQREQPAAPASSQGLEQAPQIRRVQASSSNTDSLPTRSQ

DLGYQQPTLSNPAAQALASYSTTAAYASEYDAQEVLGLDLYA

A search of sequence databases reveals that the NOV113 amino acid sequence has 68 of 115 amino acid residues (59%) identical to, and 87 of 1115 amino acid residues (75%) similar to, the 115 amino acid residue ptnr:TREMBLNEW-ACC: AAG07072 protein from *Pseudomonas aeruginosa* Hypothetical 12.1 KDA Protein (E=1.1e$^{-27}$). Public amino acid databases include the GenBank databases, SwissProt, PDB and PIR.

Neuromodulin (GAP43), neurogranin (RC3), and PEP-19 are small acid-stable proteins that bind calcium-poor calmodulin through a loosely conserved IQ-motif. Even though these proteins have been known for many years, much about their function in cells is not understood. It has recently become appreciated that calmodulin activity in cells is tightly controlled and that pools of otherwise free calmodulin are sequestered so as to restrict its availability for activating calcium/calmodulin-dependent enzymes. Neuromodulin, neurogranin, and PEP-19 appear to be major participants in this type of regulation. One way in which they do this is by providing localized increases in the concentration of calmodulin in cells so that the maximal level of target activation is increased. Additionally, they can function as calmodulin antagonists by directly inhibiting the association of calcium/calmodulin with enzymes and other proteins. Although neuromodulin, neurogranin, and PEP-19 were early representatives of the small IQ-motif-containing protein family, newer examples have come to light that expand the number of cellular systems through which the IQ-peptide/calmodulin interaction could regulate biological targets by some agonists while simultaneously permitting activation of these same targets by other agonists. Much of the mechanism for how this occurs is unknown, and possible explanations are examined. One of the biological consequences for a cell that expresses a calmodulin-regulatory protein could be an increased resistance to calcium-mediated toxicity. This possibility is examined for cells expressing PEP-19 and both anatomical and cell-biological data is described. The study of IQ-motif-containing small proteins has stimulated considerable thought as to how calcium signaling is refined in neurons. Current evidence suggests that signaling through calmodulin is not a fulminating and homogenous process but a spatially limited and highly regulated one. Data from studies on neuromodulin, neurogranin, and PEP-19 suggest that they play an important role in establishing some of the processes by which this regulation is accomplished.

The disclosed NOV13 nucleic acid of the invention encoding a Neuromodulin-like protein includes the nucleic acid whose sequence is provided in Table 13A or a fragment thereof. The invention also includes a mutant or variant nucleic acid any of whose bases may be changed from the corresponding base shown in Table 13A while still encoding a protein that maintains its Neuromodulin-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 39 percent of the bases may be so changed.

The disclosed NOV13 protein of the invention includes the Neuromodulin-like protein whose sequence is provided in Table 13B. The invention also includes a mutant or variant protein any of whose residues may be changed from the corresponding residue shown in Table 13B while still encoding a protein that maintains its Neuromodulin-like activities and physiological functions, or a functional fragment thereof. In the mutant or variant protein, up to about 30 percent of the residues may be so changed.

The invention further encompasses antibodies and antibody fragments, such as $F_{ab}$ or $(F_{ab})_2$, that bind immunospecifically to any of the proteins of the invention.

The above defined information for this invention suggests that this Neuromodulin-like protein (NOV13) may function as a member of a "Neuromodulin family". Therefore, the NOV13 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV13 nucleic acids and proteins of the invention are useful in potential therapeutic applications implicated in various pathologies and disorders.

NOV13 nucleic acids and polypeptides are further useful in the generation of antibodies that bind immunospecifically to the novel NOV13 substances for use in therapeutic or diagnostic methods. These antibodies may be generated according to methods known in the art, using prediction from hydrophobicity charts, as described in the "Anti-NOVX Antibodies" section below. The disclosed NOV113 protein has multiple hydrophilic regions, each of which can be used as an immunogen. These novel proteins can be used in assay systems for functional analysis of various human disorders, which will help in understanding of pathology of the disease and development of new drug targets for various disorders.

NOV14

NOV14 includes three novel Prostatin Precursor-like proteins disclosed below. The disclosed sequences have been named NOV14a and NOV14b.

NOV14a

A disclosed NOV14a nucleic acid of 1102 nucleotides (also referred to as CG56075-01) encoding a novel Prostatin Precursor-like protein is shown in Table 14A. An open reading frame was identified beginning with an ATG initiation codon at nucleotides 19–21 and ending with a TGG codon at nucleotides 1051–1053. A putative untranslated region upstream from the initiation codon is underlined in Table 14A. The start and stop codons are in bold letters. Because the stop codon is not a traditional termination codon, NOV14a could be a partial reading frame. Therefore, it could extend further in the 3' direction.

TABLE 14A

NOV14a nucleotide sequence (SEQ ID NO:43).

GGGCCCTTGTCCTGGGCCATGGCCCAGAAGGGGGTCCTGGGGCCTGGGCAGCTGGGGGCTGTGGCCAATTCT

GACTCATACTCACTTTACGGGTTGGTGCCGTCCGGACCCGCTAGGGGCCCCCCGTACTGCGGGCGCCCTGAG

CCCTCGGCCCGCATCGTGGGGGGCTCAAACGCGCAGCCGGCCACCTGGCCTTGGCAAGTGAGCCTGCACCAT

GGAGGTGGCCACATCTGCGGGGGCTCCCTCATCGCCCCCTCCTGGGTCCTCTCCGCTGCTCACTGTTTCATG

ACGAATGGGACGTTGGAGCCCGCGGCCGAGTGGTCGGTACTGCTGGGCGTGCACTCCCAGGACGGGCCCCTG

GACGGCGCGCACACCCGCGCAGTGGCCGCCATCGTGGTGCCGGCCAACTACAGCCAAGTGGAGCTGGGCGCC

GACCTGGCCCTGCTGCGCCTGGCCTCACCCGCCAGCCTGGGCCCCGCCGTGTGGCCTGTCTGCCTGCCCCGC

GCCTCACACCGCTTCGTGCACGGCACCGCCTGCTGGGCCACCGGCTGGGGAGACGTCCAGGAGGCAGATCCT

CTGCCTCTCCCCTGGGTGCTACAGGAAGTGGAGCTAAGGCTGCTGGGCGAGGCCACCTGTCAATGTCTCTAC

AGCCAGCCCGGTCCCTTCAACCTCACTCTCCAGATATTGCCAGGGATGCTGTGTGCTGGCTACCCAGAGGGC

CGCAGGGACACCTGCCAGGGTGACTCTGGGGGGCCCCTGGTCTGTGAGGAAGGCGGCCGCTGGTTCCAGGCA

GGAATCACCAGCTTTGGGTTTGGCTGTGGACGGAGAAACCGCCCTGGAGTTTTCACTGCTGTGGCTACCTAT

GAGGCATGGATACGGGAGCAGGTGATGGGTTCAGAGCCTGGGCCTGCCTTTCCCACCCAGCCCCAGAAGACC

CAGTCAGATTGTTTACATCAAACGGCATTCCTGGATTCTGCCAGAATCCTTTTGAGGCCCTTGTCCCATATA

TCAGTAGGAGTCTCAACTGGGACCAAAAGCCTTGTCCTCCCCTGGCTCTCTCCACACTCTCTCCTGGGCCTC

TGGGGGTTCTGATGGGCCTCC

In a search of public sequence databases, the NOV14a nucleic acid sequence, located on chromosome 16 has 469 of 795 bases (58%) identical to a gb:GENBANK-ID:BTTRYPTMR|acc:X94982.1 mRNA from Bos taurus (*B. taurus* mRNA for tryptase) ($E=2.7e^{-21}$). Public nucleotide databases include all GenBank databases and the GeneSeq patent database.

The disclosed NOV14a polypeptide (SEQ ID NO:44) encoded by SEQ ID NO:43 has 344 amino acid residues and is presented in Table 14B using the one-letter amino acid code. Signal P, Psort and/or Hydropathy results predict that NOV14a has no signal peptide and is likely to be localized extracellularly with a certainty of 0.4500. In other embodiments, NOV14a may also be localized to the microbody (peroxisome) with a certainty of 0.4370, the lysosome (lumen) with a certainty of 0.3047, or to the mitochondrial matrix space with a certainty of 0.1000.

($E=3.9e^{-65}$). Public amino acid databases include the GenBank databases, SwissProt, PDB and PIR NOV14a is expressed in at least Heart. This information was derived by determining the tissue sources of the sequences that were included in the invention including but not limited to Seq-Calling sources, Public EST sources, Literature sources, and/or RACE sources.

In addition, the sequence is predicted to be expressed in Heart because of the expression pattern of (GENBANK-ID: gb:GENBANK-ID:BTTRYPTMR|acc:X94982.1) a closely related *B. taurus* in RNA for tryptase homolog.

NOV14b

A disclosed NOV14b nucleic acid of 1102 nucleotides (also referred to as CG56075-01) encoding a novel Prostatin

TABLE 14B

Encoded NOV14a protein sequence (SEQ ID NO:44).

MAQKGVLGPGQLGAVANSDSYSLYGLVPSGPARGPPYCGRPEPSARIVGGSNAQPGTWPWQVSLHHGGGHIC

CGSLIAPSWVLSAAHCFMTNGTLEPAAEWSVLLGVHSQDGPLDGAHTRAVAAIVVPANYSQVELGADLALLR

LASPASLGPAVWPVCLPRASHRFVHGTACWATGWGDVQEADPLPLPWVLQEVELRLLGEATCQCLYSQPGPF

NLTLQILPGMLCAGYPEGRRDTCQGDSGGPLVCEEGGRWFQAGITSFGFGCGRRNRPGVFTAVATYEAWIRE

QVMGSEPGPAFPTQPQKTQSDCLHQTAFLDSARILLRPLSHISVGVSTGTKSLVLP

A search of sequence databases reveals that the NOV14a amino acid sequence has 149 of 340 amino acid residues (43%) identical to, and 197 of 340 amino acid residues (57%) similar to, the 343 amino acid residue ptnr:SWISSPROT-ACC:Q16651 protein from *Homo sapiens* (Human) (Prostasin Precursor (EC 3.4.21.-))

Precursor-like protein is shown in Table 14C. An open reading frame was identified beginning with an ATG initiation codon at nucleotides 19–21 and ending with a TGA codon at nucleotides 1090–1092. A putative untranslated region upstream from the initiation codon is underlined in Table 14C. The start and stop codons are in bold letters.

TABLE 14C

NOV14b nucleotide sequence (SEQ ID NO:45).

<u>GGGCCCTTGTCCTGGGCC</u>ATGGCCCAGAAGGGGGTCCTGGGGCCTGGGCAGCTGGGGGCTGTGGCCAATTCT

GACTCATACTCACTTTACGGGTTGGTGCCGTCCGGACCCGCTAGGGGCCCCCCGTACTGCGGGCGCCCTGAG

CCCTCGGCCCGCATCGTGGGGGGCTCAAACGCGCAGCCGGGCACCTGGCCTTGGCAAGTGAGCCTGCACCAT

GGAGGTGGCCACATCTGCGGGGGCTCCCTCATCGCCCCCTCCTGGGTCCTCTCCGCTGCTCACTGTTTCATG

ACGAATGGGACGTTGGAGCCCGCGGCCGAGTGGTCGGTACTGCTGGGCGTGCACTCCCAGGGACGGCCCCTG

GACGGCGCGCACACCCGCGCAGTGGCCGCCATCGTGGTGCCGGCCAACTACAGCCAAGTGGAGCTGGGCGCC

GACCTGGCCCTGCTGCGCCTGGCCTCACCCGCCAGCCTGGGCCCCGCCGTGTGGCCTGTCTGCCTGCCCCGC

GCCTCACACCGCTTCGTGCACGGCACCGCCTGCTGGGCCACCGGCTGGGGAGACGTCCAGGAGGCAGATCCT

CTGCCTCTCCCCTGGGTGCTACAGGAAGTGGAGCTAAGGCTGCTGGGCGAGGCCACCTGTCAATGTCTCTAC

AGCCAGCCCGGTCCCTTCAACCTCACTCTCCAGATATTGCCAGGGATGCTGTGTGCTGGCTACCCAGAGGGC

CGCAGGGACACCTGCCAGGGTGACTCTGGGGGGCCCCTGGTCTGTGAGGAAGGCGGCCGCTGGTTCCAGGCA

GGAATCACCAGCTTTGGGTTTGGCTGTGGACGGAGAAACCGCCCTGGAGTTTTCACTGCTGTGGCTACCTAT

GAGGCATGGATACGGGAGCAGGTGATGGGTTCAGACCCTGGGCTGCCTTTCCCACCCAGCCCCAGAAGACC

CAGTCAGATTGTTTACATCAAACGGCATTCCTGGATTCTGCCAGAATCCTTTTGAGGCCCTTGTCCCATATA

TCAGTAGGAGTCTCAACTGGGACCAAAAGCCTTGTCCTCCCCTGGCTCTCTCCACACTCTCTCCTGGGCCTC

TGGGGGTTCTGATGGGCCTCC

The disclosed NOV14b polypeptide (SEQ ID NO:46) encoded by SEQ ID NO:45 has 357 amino acid residues and is presented in Table 14D using the one-letter amino acid code.

TABLE 14D

Encoded NOV14b protein sequence (SEQ ID NO:46).

MAQKGVLGPGQLGAVANSDSYSLYGLVPSGPARGPPYCGRPEPSARIVGGSNAQPGTWPWQVSLHHGGGHIC

GGSLIAPSWVLSAAHCFMTNGTLEPAAEWSVLLGVHSQDGPLDGAHTRAVAAIVVPANYSQVELGADLALLR

LASPASLGPAVWPVCLPRASHRFVHGTACWATGWGDVQEADPLPLPWVLQEVELRLLGEATCQCLYSQPGPF

NLTLQILPGMLCAGYPEGRRDTCQGDSGGPLVCEEGGRWFQAGITSFGFGCGRRNRPGVFTAVATYEAWIRE

QVMGSEPGPAFPTQPQKTQSDCLHQTAFLDSARILLRPLSHISVGVSTGTKSLVLPWLSPHSLLGLWGF

The disclosed NOV14 polypeptide has homology to the amino acid sequences shown in the BLASTP data listed in Table 14E.

well as all other ClustalW analyses herein, the black outlined amino acid residues indicate regions of conserved sequence (i.e., regions that may be required to preserve structural or functional properties), whereas non-highlighted amino acid residues are less conserved and can potentially be altered to a much broader extent without altering protein structure or function.

TABLE 14E

BLAST results for NOV14

| Gene Index/ Identifier | Protein/Organism | Length (aa) | Identity (%) | Positives (%) | Expect |
|---|---|---|---|---|---|
| gi\|4506153\|ref\|NP_002764.1\| (NM_002773) | protease, serine, 8 (prostasin) [Homo sapiens] | 343 | 140/333 (42%) | 180/333 (54%) | 1e-51 |
| gi\|6009515\|dbj\|BAA84941.1\| (AB018694) | epidermis specific serine protease [Xenopus laevis] | 389 | 104/265 (39%) | 144/265 (54%) | 2e-49 |
| gi\|12249015\|dbj\|BAB20376.1\| (AB030036) | prostamin [Homo sapiens] | 855 | 103/249 (41%) | 140/249 (55%) | 4e-47 |
| gi\|11181573\|gb\|AAG32641.1\| AF202076_1 (AF202076) | prostasin [Rattus norvegicus] | 342 | 130/347 (37%) | 175/347 (49%) | 4e-47 |
| gi\|13632973\|sp\|Q9ES87\| PSS8_RAT | Prostasin precursor | 342 | 130/347 (37%) | 175/347 (49%) | 6e-47 |

The homology between these and other sequences is shown graphically in the ClustalW analysis shown in Table 14F. In the ClustalW alignment of the NOV14 protein, as

TABLE 14F

ClustalW Analysis of NOV14

1) Novel NOV14a (SEQ ID NO:44)
2) Novel NOV14b (SEQ ID NO:46)
3) gi|4506153|ref|NP_002764.1| (NM_002773) protease, serine, 8 (prostasin) [Homo sapiens] (SEQ ID NO:130)
4) gi|6009515|dbj|BAA84941.1| (AB018694) epidermis specific serine protease [Xenopus laevis] (SEQ ID NO:131)
5) gi|12249015|dbj|BAB20376.1| (AB030036) prostamin [Homo sapiens] (SEQ ID NO:132)
6) gi|11181573|gb|AAG32641.1|AF202076_1 (AF202076) prostasin [Rattus norvegicus] (SEQ ID NO:133)
7) gi|23632973|sp|Q9ES87|PSS8_RAT Prostasin precursor (SEQ ID NO:134)

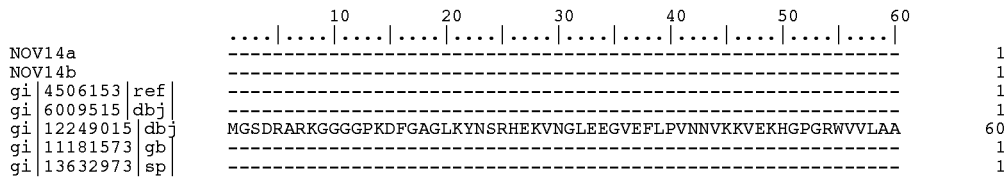

TABLE 14F-continued

ClustalW Analysis of NOV14

```
                      70        80        90       100       110       120
                ....|....|....|....|....|....|....|....|....|....|....|....|
NOV14a          ------------------------------------------------------------   1
NOV14b          ------------------------------------------------------------   1
gi|4506153|ref| ------------------------------------------------------------   1
gi|6009515|dbj| ------------------------------------------------------------   1
gi|12249015|dbj VLIGLLLVLLGIGFLVWHLQYRDVRVQKVFNGYMRITNENFVDAYENSNSTEFVSLASKV   120
gi|11181573|gb| ------------------------------------------------------------   1
gi|13632973|sp| ------------------------------------------------------------   1

130       140       150       160       170       180
                ....|....|....|....|....|....|....|....|....|....|....|....|
NOV14a          ------------------------------------------------------------   1
NOV14b          ------------------------------------------------------------   1
gi|4506153|ref| ------------------------------------------------------------   1
gi|6009515|dbj| ------------------------------------------------------------   1
gi|12249015|dbj KDALKLLYSGVPFLGPYHKESAVTAFSEGSVIAYYWSEFSIPQHLVEEAERVMAEERVVM   180
gi|11181573|gb| ------------------------------------------------------------   1
gi|13632973|sp| ------------------------------------------------------------   1

190       200       210       220       230       240
                ....|....|....|....|....|....|....|....|....|....|....|....|
NOV14a          ------------------------------------------------------------   1
NOV14b          ------------------------------------------------------------   1
gi|4506153|ref| ------------------------------------------------------------   1
gi|6009515|dbj| ------------------------------------------------------------   1
gi|12249015|dbj LPPRARSLKSFVVTSVVAFPTDSKTVQRTQDNSCSFGLHARGVELMRFTTPGFPDSPYPA   240
gi|11181573|gb| ------------------------------------------------------------   1
gi|13632973|sp| ------------------------------------------------------------   1

250       260       270       280       290       300
                ....|....|....|....|....|....|....|....|....|....|....|....|
NOV14a          ------------------------------------------------------------   1
NOV14b          ------------------------------------------------------------   1
gi|4506153|ref| ------------------------------------------------------------   1
gi|6009515|dbj| ------------------------------------------------------------   1
gi|12249015|dbj HARCQWALRGDADSVLSLTFRSFDLASCDERGSDLVTVYNTLSPMEPHALVQLCGTYPPS   300
gi|11181573|gb| ------------------------------------------------------------   1
gi|13632973|sp| ------------------------------------------------------------   1

310       320       330       340       350       360
                ....|....|....|....|....|....|....|....|....|....|....|....|
NOV14a          ------------------------------------------------------------   1
NOV14b          ------------------------------------------------------------   1
gi|4506153|ref| ------------------------------------------------------------   1
gi|6009515|dbj| ------------------------------------------------------------   1
gi|12249015|dbj YNLTFHSSQNVLLITLITNTERRHPGFEATFFQLPRMSSCGGRLRKAQGTFNSPYYPGHY   360
gi|11181573|gb| ------------------------------------------------------------   1
gi|13632973|sp| ------------------------------------------------------------   1

370       380       390       400       410       420
                ....|....|....|....|....|....|....|....|....|....|....|....|
NOV14a          ------------------------------------------------------------   1
NOV14b          ------------------------------------------------------------   1
gi|4506153|ref| ------------------------------------------------------------   1
gi|6009515|dbj| ------------------------------------------------------------   1
gi|12249015|dbj PPNIDCTWNIEVPNNQHVKVRFKFFYLLEPGVPAGICPKDYVEINGEKYCGERSQFVVTS   420
gi|11181573|gb| ------------------------------------------------------------   1
gi|13632973|sp| ------------------------------------------------------------   1

430       440       450       460       470       480
                ....|....|....|....|....|....|....|....|....|....|....|....|
NOV14a          ------------------------------------------------------------   1
NOV14b          ------------------------------------------------------------   1
gi|4506153|ref| ------------------------------------------------------------   1
gi|6009515|dbj| ------------------------------------------------------------   1
gi|12249015|dbj NSNKITVRFHSDQSYTDTGFLAEYLSYDSSDPCPGQFTCRTGRCIRKELRCDGWADCTDH   480
gi|11181573|gb| ------------------------------------------------------------   1
gi|13632973|sp| ------------------------------------------------------------   1

490       500       510       520       530       540
                ....|....|....|....|....|....|....|....|....|....|....|....|
NOV14a          ------------------------------------MAQKGVLCPGQLGAVAN----SD   19
NOV14b          ------------------------------------MAQKGVLCPGQLGAVAN----SD   19
gi|4506153|ref| ------------------------------------MAQKGVLCPGQLGAVAI------   17
gi|6009515|dbj| ------------------------------------MLQYLSFVLIFHHQAC------   17
gi|12249015|dbj SDELNCSCDAGHQFTCKNKFCKPLFWVCDSVNDCGDNSDEQGCSCPAQTFRCSNGKCLSK   540
gi|11181573|gb| ------------------------------------MALRVGLGLGQLEALFV------   17
gi|13632973|sp| ------------------------------------MALRVGLGLGQLEALFI------   17
```

TABLE 14F-continued

ClustalW Analysis of NOV14

```
                    550       560       570       580       590       600
               ....|....|....|....|....|....|....|....|....|....|....|....|
NOV14a         SYSLYGLVPSGP---------------------------ARGPPYCGRPEPS-------      44
NOV14b         SYSLYGLVPSGP---------------------------ARGPPYCGRPEPS-------      44
gi|4506153|ref|  -LLYLGLIRSGTG---------------------------AEGAPAP-------        36
gi|6009515|dbj|  -----GVPVISN----------------------------------------            24
gi|12249015|dbj| SQQCNGKDDCGDGSDEASCPKVNVVTCTKHTYRCLNGLCLSKGNPECDGKEDCSDGSDEK    600
gi|11181573|gb|  -LLLIGLIQSRIG---------------------------ADGTPAS-------        36
gi|13632973|sp|  -LLLIGLIQSRIG---------------------------ADGTPAS-------        36

610       620       630       640       650       660
               ....|....|....|....|....|....|....|....|....|....|....|....|
NOV14a         ------------ARIVGGSNAPGLWPWQVSLHMGG-GHLCCGSLIAPSWVLSAAHCPMT     91
NOV14b         ------------ARIVGGSNAPGLWPWQVSLHMGG-GHLCCGSLIAPSWVLSAAHCPMT     91
gi|4506153|ref|  ---CG-----VAPQARITGGSSAVAGWPWQVSLTYEG-VELCGGSLVEQWVLSAAHCPPS   89
gi|6009515|dbj|  --------------RIVGGMDSKRGWPWQISLKS-DSLCGGSLIDSWVLPLISRETCNC   70
gi|12249015|dbj| DCDCGLRSFTRQARVVGGTDAEGSWPWQVSLHALGQGHLCGASLISPNWLVSAAECVID    660
gi|11181573|gb|  ---CG----AVIQPRITGGGSAKPGWPWQVSLTYNG-VHLCGGSLISNQWVVSAAECPPR   89
gi|13632973|sp|  ---CG----AVIQPRITGGGSAKPGWPWQVSLTYNG-VHLCGGSLISNQWVVSAAECPPR   89

670       680       690       700       710       720
               ....|....|....|....|....|....|....|....|....|....|....|....|
NOV14a         NG--TLEPAAENSVLLGVHSQ-DGPLEGAHTRAVAAIVVPANYSQVELGADIALIRLASP   148
NOV14b         NG--TLEPAAENSVLLGVHSQ-DGPLEGAHTRAVAAIVVPANYSQVELGADIALIRLASP   148
gi|4506153|ref|  EH-----HKEAVEVKLGAH-QLDSYSEDAKVSTLKDITPEPSYLQEGSQGDIALLSLRP    143
gi|6009515|dbj|  LD------VSYRTVYLGAR-QLSAPDNSTVSRGVKSITKHPDEQYEGSSGDIALKELEKP   123
gi|12249015|dbj| DRGFRYSDPTGNTVFLGLSDQSQRSAPGVQERRKRITSHPFENDFTFDYDIALLELEKP   720
gi|11181573|gb|  EH-----SKEEKEVKLGAH-QLDSFSNDIVVHTVAQILHSSYREEGSQGDIALKRLSSP   143
gi|13632973|sp|  EH-----SKEEKEVKLGAH-QLDSFSNDIVVHTVAQILHSSYREEGSQGDIALKRLSSP   143

730       740       750       760       770       780
               ....|....|....|....|....|....|....|....|....|....|....|....|
NOV14a         AELGPAVWPVCLPRASHREVHGTACWATGWGDVQEADPLPLPWVLQEVELRLIGEATCQC   208
NOV14b         AELGPAVWPVCLPRASHREVHGTACWATGWGDVQEADPLPLPWVLQEVELRLIGEATCQC   208
gi|4506153|ref|  ITPERYIRPICLPAANASFPNGLHCTVTGWGAAPSVSLLTPRPLQEVAIDSSVCGT     203
gi|6009515|dbj|  VTETPYILPICLPSQDVQFAAGTMCWVTGWGNTQEGTPLISPKTIQKAEVAIDSSVCGT   183
gi|12249015|dbj| AENSSMVRPICLPDASHVFPAGKAIWVTGWGHTQYGGTG--ALILQKGERVMNQTTCEN   778
gi|11181573|gb|  VTERYIRPICLPAANASFPNGLHCTVTGWGHVAPSVSLQTPRPLQKIEVPLISRETCSC   203
gi|13632973|sp|  VTERYIRPICLPAANASFPNGLHCTVTGWGHVAPSVSLQTPRPLQKIEVPLISRETCSC   203

790       800       810       820       830       840
               ....|....|....|....|....|....|....|....|....|....|....|....|
NOV14a         LYSQPG-PFNLTLQILPGMICAGYPEGRDICQGDSGGPLVCEEG-GRWEQAGIISGFG    266
NOV14b         LYSQPG-PFNLTLQILPGMICAGYPEGRDICQGDSGGPLVCEEG-GRWEQAGIISGFG    266
gi|4506153|ref|  LYNIDA-KPEEPHFVQEDMICAGYVEGKDACQGDSGGPLSCPVE-CLWELTGIVSWGDA   261
gi|6009515|dbj|  WYESSLGYIPDFSFIQEDMVCAGYLEGGRDACQGDSGGPLVCNVN-NVWLQLGIVSWGYG   242
gi|12249015|dbj| LLPQ---------QITPRMICVGHLSGGVDACQGDSGGPLSSVEADGRIKAGYVSWGDG   829
gi|11181573|gb|  LYNINA-VPEEPHTLQQDMICAGYKGKDACQGDSGGPLSCPID-GLWHLAGIVSWGDA   261
gi|13632973|sp|  LYNINA-VPEEPHTLQQDMICAGYKGKDACQGDSGGPLSCPID-GLWHLAGIVSWGDA   261

850       860       870       880       890       900
               ....|....|....|....|....|....|....|....|....|....|....|....|
NOV14a         CGRRNRPGVKTAVATYEAWIREQV-----------------------------       290
NOV14b         CGRRNRPGVKTAVATYEAWIREQV-----------------------------       290
gi|4506153|ref|  CGARNRPGVYTLASSYASWIQSKV-----------------------------       285
gi|6009515|dbj|  CAEPNRPGVYTKVQYYQDWKKTNVPLIVFSEEGPSVAPSIGPSIAPSFGPSLGPRGVAST   302
gi|12249015|dbj| CAQRNKPGVYTRLPLIRDWIKENT-----------------------------       853
gi|11181573|gb|  CGAPNKPGVYTLTSYASWIHHHV-----------------------------       285
gi|13632973|sp|  CGAPNKPGVYTLTSYASWIHHHV-----------------------------       285

910       920       930       940       950       960
               ....|....|....|....|....|....|....|....|....|....|....|....|
NOV14a         --MGSEPGPAFPTQPQKTQSDCL--HQTAPEDSARILLRPESHISVGVSTGTKSLVLP--   344
NOV14b         --MGSEPGPAFPTQPQKTQSDCL--HQTAFEDSARILLRPESHISVGVSTGTKSLVLPWL   346
gi|4506153|ref|  --TELQPRVVPQTQESEPDSNLCGSHLAFSPMAQGLLRPLLFLPELGLLSPWLSEH      343
gi|6009515|dbj|  TISQTEAQSVNSIEIDKTNSTTIFETEAMSMSNNTTMNETFSLVSSTISTALRINETKTI   362
gi|12249015|dbj| --GV-----------------------------------------       855
gi|11181573|gb|  --AELQPRVVPQTQESEPDGHLCNHHPVFNIAAAKLSRPILFEPISIITGLFSLWLEH-   342
gi|13632973|sp|  --AELQPRAVPQTQESEPDGHLCNNHPVFNIAAAKLSRPILFEPISIITGLFSLWLEH-   342

970       980
               ....|....|....|....|....|..
NOV14a         --------------------------    344
NOV14b         SPHSLLGLWGF---------------    357
gi|4506153|ref|  --------------------------    343
gi|6009515|dbj|  DNEAQIHACSLHTIALTLIYLFIRFFV   389
gi|12249015|dbj| --------------------------    855
gi|11181573|gb|  --------------------------    342
gi|13632973|sp|  --------------------------    342
```

Tables 14G–H lists the domain descriptions from DOMAIN analysis results against NOV14. This indicates that the NOV14 sequence has properties similar to those of other proteins known to contain this domain.

TABLE 14G

Domain Analysis of NOV14

```
gnl|Smart|smart00020, Tryp_SPc, Trypsin-like serine protease; Many of
these are synthesised as inactive precursor zymogens that are cleaved
during limited proteolysis to generate their active forms. A few,
however, are active as single chain molecules, and others are inactive
due to substitutions of the catalytic triad residues. (SEQ ID NO:135)
CD-Length = 230 residues, 100.0% aligned
Score = 209 bits (531), Expect = 3e-55

Query:    46 RIVGGSNAQPGTWPWQVSLH-HGGGHICGGSLIAPSWVLSAAHCFMTNGTLEPAAEWSVL  104
             ||||||  |  |++||||||    ||  |  ||||||+|  |||+|||    +      +       |
Sbjct:     1 RIVGGSEANIGSFPWQVSLQYRGGRHFCGGSLISPRWVLTAAHCVYGS----APSSIRVR   56

Query:   105 LGVHSQDGPLDGAHTRAVAAIVVPANYSQVELGADLALLRLASPASLGPAVWPVCLPRAS  164
             || |    +      |   |+ ++|   ||+      |+|||+|+  | +|    | |+|||  +
Sbjct:    57 LGSHDLSSG-EETQTVKVSKVIVHPNYNPSTYDNDIALLKLSEPVTLSDTVRPICLPSSG  115

Query:   165 HRFVHGTACWATGWGDVQEADPLPLPWVLQEVELRLLGEATCQCLYSQPGPFNLTLQILP  224
             +        ||  |   +|||      |+       ||    ||||   +  ++       |||+   ||                |
Sbjct:   116 YNVPAGTTCTVSGWGRTSESSG-SLPDTLQEVNVPIVSNATCRRAYSGGPA------ITD  168

Query:   225 GMLCAGYPEGRRDTCQGDSGGPLVCEEGGRWFQAGITSFG-FGCGRRNRPGVFTAVATYE  283
             |||||  || +| ||||||||||||    ||    ||  |+|  +||    |+|||+|  |++|
Sbjct:   169 NMLCAGGLEGGKDACQGDSGGPLVC-NDPRWVLVGIVSWGSYGCARPNKPGVYTRVSSYL  227

Query:   284 AWI                                                          286
             ||
Sbjct:   228 DWI                                                          230
```

TABLE 14H

Domain Analysis of NOV14

```
gnl|Pfam|pfam00089, trypsin, Trypsin. Proteins recognized include all
proteins in families S1, S2A, S2B, S2C, and S5 in the classification
of peptidases. Also included are proteins that are clearly members,
but that lack peptidase activity, such as haptoglobin and protein Z
(PRTZ*). (SEQ ID NO:136)
CD-Length = 217 residues, 100.0% aligned
Score = 165 bits (417), Expect = 5e-42

Query:    47 IVGGSNAQPGTWPWQVSLHHGGGHICGGSLIAPSWVLSAAHCFMTNGTLEPAAEWSVLLG  106
             ||||   ||  |++||||||     ||  ||||||+  +|||+||||          |+    |+||
Sbjct:     1 IVGGREAQAGSFPWQVSLQVSSGHFCGGSLISENWVLTAAHCVSG------ASSVRVVLG   54

Query:   107 VHSQDGPLDGAHTRAVAAIVVPANYSQVELGADLALLRLASPASLCPAVWPVCLPRASHR  166
             |+                |  |+|   ||+       |+|||+|   || +||    | |+|||   ||
Sbjct:    55 EHNLGTTEGTEQKFDVKKIIVHPNYNP--DTNDIALLKLSPVTLGDTVRPICLPSASSD  112

Query:   167 FVHGTACWATGWGDVQEADPLPLPWVLQEVELRLLGEATCQCLYSQPGPFNLTLQILPGM  226
             ||   |  +|||     +                ||||   +  ++   ||+    |                  +        |
Sbjct:   113 LPVGTTCSVSGWGRTKNLGT---SDTLQEVVVPIVSRETCRSAYGGT--------VTDTM  161

Query:   227 LCAGYPEGRRDTCQGDSGGPLVCEEGGRWFQAGITSFGFGCGRRNRPGVFTAVATYEAWI  286
             +|||       |  +|  ||||||||||||  +|           ||  |+|+||      |   |||+|  |+   |       ||
Sbjct:   162 ICAGALGG-KDACQGDSGGPLVCSDG---ELVGIVSWGYGCAVGNYPGVYTRVSRYLDWI  217
```

Human seminal fluid contains a variety of proteolytic enzymes, including prostate-specific antigen and acrosin. These enzymes are involved in the postejaculatory hydrolysis of proteins and in semen coagulation and liquefaction. Yu et al. (1995) obtained partial amino acid sequence of a 40-kcD protein isolated from seminal fluid originally by Yu et al. (1994). Yu et al. (1995) designed degenerate primers based on the amino acid sequence and used to screen a human prostate cDNA library by PCR. The 3-prime end of the cDNA was obtained by the RACE (rapid amplification of cDNA ends) method. A 1.8-kb cDNA sequence was assembled encoding a predicted protein of 343 amino acids which contains a 32-amino acid signal peptide. The protein, designated serine protease-8 (gene symbol=PRSS8), was called prostasin by the authors. The precursor, proprostasin, is cleaved between residues 12 and 13 to produce a 12-amino acid light chain and a 299-amino acid heavy chain which are associated through a disulfide bond. The predicted amino acid sequence is between 34 and 42% identical to human acrosin, plasma kallikrein, and hepsin. The deduced protein has a hydrophobic domain at the C terminus, indicating to the authors that it may be membrane anchored. The authors showed that the hydrophobic region is cleaved between residues 290 and 291 during secretion. Expression levels of the prostasin mRNA were assayed by Southern blots of RT-PCR products. Expression was noted in a wide variety of tissues. In the prostate gland, expression was localized to the epithelial cells. Yu et al. (1996) isolated and characterized the full length PRSS8 gene. They found that it consists of 6 exons and 5 introns. The authors characterized the 5-prime flanking region of the gene and found a number of potential regulatory elements, including an AP2 site, 2 erythroid-specific promoter elements, and a sterol regulatory element, although no TATA box was found. In addition, there were a variant GC box and a variant AP1 site in the promoter region. Prostasin, denoted as PRSS8, is a newly identified human serine proteinase that shares high sequence identity with acrosin, plasma kallikrein, and hepsin (Yu et al., 1994, 1995). In the present study, a full-length PRSS8 gene has been isolated and characterized. A 7-kb PRSS8 gene fragment has been sequenced, including a 1.4-kb 5'-flanking region, the 4.4-kb PRSS8 gene, and a 1.2-kb 3'-flanking region. The gene consists of six exons and five introns based on comparison with its cDNA sequence. The sizes of these exons are 417, 18, 163, 272, 167, and 899 bp, while those of the introns are 243, 1763, 271, 85, and 92 bp. A number of potential regulatory elements have been revealed in the 5'-flanking region, including an AP2 site, two erythroid-specific promoter elements, and a sterol regulatory element. In addition, there are a variant GC box and a variant AP1 site in the promoter region. The transcription initiation site of the PRSS8 gene has been defined at the G residue and its adjacent A residue in a sequence CTCATGACT, which is similar to an initiator element CTCANTCT. Between the transcription initiation site and these putative regulatory elements, there is an AC-rich repetitive sequence that spans over 300 bp. Human PRSS8 is a single-copy gene and has been localized on chromosome 16p11.2 by in situ hybridization.

The disclosed NOV14 nucleic acid of the invention encoding a Prostatin Precursor-like protein includes the nucleic acid whose sequence is provided in Table 14A, 14C or a fragment thereof. The invention also includes a mutant or variant nucleic acid any of whose bases may be changed from the corresponding base shown in Table 14A, or 14C while still encoding a protein that maintains its Prostatin Precursor-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 43 percent of the bases may be so changed.

The disclosed NOV14 protein of the invention includes the Prostatin Precursor-like protein whose sequence is provided in Table 14B, or 14D. The invention also includes a mutant or variant protein any of whose residues may be changed from the corresponding residue shown in Table 14B, or 14D while still encoding a protein that maintains its Prostatin Precursor-like activities and physiological functions, or a functional fragment thereof. In the mutant or variant protein, up to about 43% percent of the residues may be so changed.

The invention further encompasses antibodies and antibody fragments, such as $F_{ab}$ or $(F_{ab})_2$, that bind immunospecifically to any of the proteins of the invention.

The above defined information for this invention suggests that this Prostatin Precursor-like protein (NOV14) may function as a member of a "Prostatin Precursor family". Therefore, the NOV14 nucleic acids and proteins identified here may be useful in potential therapeutic applications implicated in (but not limited to) various pathologies and disorders as indicated below. The potential therapeutic applications for this invention include, but are not limited to: protein therapeutic, small molecule drug target, antibody target (therapeutic, diagnostic, drug targeting/cytotoxic antibody), diagnostic and/or prognostic marker, gene therapy (gene delivery/gene ablation), research tools, tissue regeneration in vivo and in vitro of all tissues and cell types composing (but not limited to) those defined here.

The NOV14 nucleic acids and proteins of the invention are useful in potential therapeutic applications implicated in Cardiomyopathy, Atherosclerosis, Hypertension, Congenital heart defects, Aortic stenosis, Atrial septal defect (ASD), Atrioventricular (A-V) canal defect, Ductus arteriosus, Pulmonary stenosis, Subaortic stenosis, Ventricular septal defect (VSD), valve diseases, Tuberous sclerosis, Scleroderma, Obesity, Transplantation, and/or other diseases and pathologies.

NOV14 nucleic acids and polypeptides are further useful in the generation of antibodies that bind immunospecifically to the novel NOV14 substances for use in therapeutic or diagnostic methods. These antibodies may be generated according to methods known in the art, using prediction from hydrophobicity charts, as described in the "Anti-NOVX Antibodies" section below. The disclosed NOV14 protein has multiple hydrophilic regions, each of which can be used as an immunogen. These novel proteins can be used in assay systems for functional analysis of various human disorders, which will help in understanding of pathology of the disease and development of new drug targets for various disorders.

NOVX Nucleic Acids and Polypeptides

One aspect of the invention pertains to isolated nucleic acid molecules that encode NOVX polypeptides or biologically active portions thereof. Also included in the invention are nucleic acid fragments sufficient for use as hybridization probes to identify NOVX-encoding nucleic acids (e.g., NOVX mRNAs) and fragments for use as PCR primers for the amplification and/or mutation of NOVX nucleic acid molecules. As used herein, the term "nucleic acid molecule" is intended to include DNA molecules (e.g., cDNA or genomic DNA), RNA molecules (e.g., mRNA), analogs of the DNA or RNA generated using nucleotide analogs, and derivatives, fragments and homologs thereof. The nucleic acid molecule may be single-stranded or double-stranded, but preferably is comprised double-stranded DNA.

An NOVX nucleic acid can encode a mature NOVX polypeptide. As used herein, a "mature" form of a polypeptide or protein disclosed in the present invention is the product of a naturally occurring polypeptide or precursor form or proprotein. The naturally occurring polypeptide, precursor or proprotein includes, by way of nonlimiting example, the full-length gene product, encoded by the corresponding gene. Alternatively, it may be defined as the polypeptide, precursor or proprotein encoded by an ORF described herein. The product "mature" form arises, again by way of nonlimiting example, as a result of one or more naturally occurring processing steps as they may take place within the cell, or host cell, in which the gene product arises. Examples of such processing steps leading to a "mature" form of a polypeptide or protein include the cleavage of the N-terminal methionine residue encoded by the initiation codon of an ORF, or the proteolytic cleavage of a signal peptide or leader sequence. Thus a mature form arising from a precursor polypeptide or protein that has residues 1 to N, where residue 1 is the N-terminal methionine, would have residues 2 through N remaining after removal of the N-terminal methionine. Alternatively, a mature form arising from a precursor polypeptide or protein having residues 1 to N, in which an N-terminal signal sequence from residue 1 to residue M is cleaved, would have the residues from residue M+1 to residue N remaining. Further as used herein, a "mature" form of a polypeptide or protein may arise from a step of post-translational modification other than a proteolytic cleavage event. Such additional processes include, by way of non-limiting example, glycosylation, myristoylation or phosphorylation. In general, a mature polypeptide or protein may result from the operation of only one of these processes, or a combination of any of them.

The term "probes", as utilized herein, refers to nucleic acid sequences of variable length, preferably between at least about 10 nucleotides (nt), 100 nt, or as many as approximately, e.g., 6,000 nt, depending upon the specific use. Probes are used in the detection of identical, similar, or complementary nucleic acid sequences. Longer length probes are generally obtained from a natural or recombinant source, are highly specific, and much slower to hybridize than shorter-length oligomer probes. Probes may be single- or double-stranded and designed to have specificity in PCR, membrane-based hybridization technologies, or ELISA-like technologies.

The term "isolated" nucleic acid molecule, as utilized herein, is one, which is separated from other nucleic acid molecules which are present in the natural source of the nucleic acid. Preferably, an "isolated" nucleic acid is free of sequences which naturally flank the nucleic acid (i.e., sequences located at the 5'- and 3'-termini of the nucleic acid) in the genomic DNA of the organism from which the nucleic acid is derived. For example, in various embodiments, the isolated NOVX nucleic acid molecules can contain less than about 5 kb, 4 kb, 3 kb, 2 kb, 1 kb, 0.5 kb or 0.1 kb of nucleotide sequences which naturally flank the nucleic acid molecule in genomic DNA of the cell/tissue from which the nucleic acid is derived (e.g., brain, heart, liver, spleen, etc.). Moreover, an "isolated" nucleic acid molecule, such as a cDNA molecule, can be substantially free of other cellular material or culture medium when produced by recombinant techniques, or of chemical precursors or other chemicals when chemically synthesized.

A nucleic acid molecule of the invention, e.g., a nucleic acid molecule having the nucleotide sequence SEQ ID NOS:1, 3, 5, 7, 9, 11, 13, 15, 17, 19, 21, 23, 25, 27, 29, 31, 33, 35, 37, 39, 41, 43, 45, and 197, or a complement of this aforementioned nucleotide sequence, can be isolated using standard molecular biology techniques and the sequence information provided herein. Using all or a portion of the nucleic acid sequence of SEQ ID NOS: 1, 3, 5, 7, 9, 11, 13, 15, 17, 19, 21, 23, 25, 27, 29, 31, 33, 35, 37, 39, 41, 43, 45, and 197 as a hybridization probe, NOVX molecules can be isolated using standard hybridization and cloning techniques (e.g., as described in Sambrook, et al., (eds.), MOLECULAR CLONING: A LABORATORY MANUAL $2^{nd}$ Ed., Cold Spring Harbor Laboratory Press, Cold Spring Harbor, N.Y., 1989; and Ausubel, et al., (eds.), CURRENT PROTOCOLS IN MOLECULAR BIOLOGY, John Wiley & Sons, New York, N.Y., 1993.)

A nucleic acid of the invention can be amplified using cDNA, mRNA or alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to NOVX nucleotide sequences can be prepared by standard synthetic techniques, e.g., using an automated DNA synthesizer.

As used herein, the term "oligonucleotide" refers to a series of linked nucleotide residues, which oligonucleotide has a sufficient number of nucleotide bases to be used in a PCR reaction. A short oligonucleotide sequence may be based on, or designed from, a genomic or cDNA sequence and is used to amplify, confirm, or reveal the presence of an identical, similar or complementary DNA or RNA in a particular cell or tissue. Oligonucleotides comprise portions of a nucleic acid sequence having about 10 nt, 50 nt, or 100 nt in length, preferably about 15 nt to 30 nt in length. In one embodiment of the invention, an oligonucleotide comprising a nucleic acid molecule less than 100 nt in length would further comprise at least 6 contiguous nucleotides SEQ ID NOS:1, 3, 5, 7, 9, 11, 13, 15, 17, 19, 21, 23, 25, 27, 29, 31, 33, 35, 37, 39, 41, 43, 45, and 197, or a complement thereof. Oligonucleotides may be chemically synthesized and may also be used as probes.

In another embodiment, an isolated nucleic acid molecule of the invention comprises a nucleic acid molecule that is a complement of the nucleotide sequence shown in SEQ ID NOS:1, 3, 5, 7, 9, 11, 13, 15, 17, 19, 21, 23, 25, 27, 29, 31, 33, 35, 37, 39, 41, 43, 45, and 197, or a portion of this nucleotide sequence (e.g., a fragment that can be used as a probe or primer or a fragment encoding a biologically-active portion of an NOVX polypeptide). A nucleic acid molecule that is complementary to the nucleotide sequence shown SEQ ID NOS:1, 3, 5, 7, 9, 11, 13, 15, 17, 19, 21, 23, 25, 27, 29, 31, 33, 35, 37, 39, 41, 43, 45, or 197 is one that is sufficiently complementary to the nucleotide sequence shown SEQ ID NOS:1, 3, 5, 7, 9, 11, 13, 15, 17, 19, 21, 23, 25, 27, 29, 31, 33, 35, 37, 39, 41, 43, 45, or 197 that it can hydrogen bond with little or no mismatches to the nucleotide sequence shown SEQ ID NOS:1, 3, 5, 7, 9, 11, 13, 15, 17, 19, 21, 23, 25, 27, 29, 31, 33, 35, 37, 39, 41, 43, 45, and 197, thereby forming a stable duplex.

As used herein, the term "complementary" refers to Watson-Crick or Hoogsteen base pairing between nucleotides units of a nucleic acid molecule, and the term "binding" means the physical or chemical interaction between two polypeptides or compounds or associated polypeptides or compounds or combinations thereof. Binding includes ionic, non-ionic, van der Waals, hydrophobic interactions, and the like. A physical interaction can be either direct or indirect. Indirect interactions may be through or due to the effects of another polypeptide or compound. Direct binding refers to interactions that do not take place through, or due to, the effect of another polypeptide or compound, but instead are without other substantial chemical intermediates.

Fragments provided herein are defined as sequences of at least 6 (contiguous) nucleic acids or at least 4 (contiguous) amino acids, a length sufficient to allow for specific hybridization in the case of nucleic acids or for specific recognition of an epitope in the case of amino acids, respectively, and are at most some portion less than a full length sequence. Fragments may be derived from any contiguous portion of a nucleic acid or amino acid sequence of choice. Derivatives are nucleic acid sequences or amino acid sequences formed from the native compounds either directly or by modification or partial substitution. Analogs are nucleic acid sequences or amino acid sequences that have a structure similar to, but not identical to, the native compound but differs from it in respect to certain components or side chains. Analogs may be synthetic or from a different evolutionary origin and may have a similar or opposite metabolic activity compared to wild type. Homologs are nucleic acid sequences or amino acid sequences of a particular gene that are derived from different species.

Derivatives and analogs may be full length or other than full length, if the derivative or analog contains a modified nucleic acid or amino acid, as described below. Derivatives or analogs of the nucleic acids or proteins of the invention include, but are not limited to, molecules comprising regions that are substantially homologous to the nucleic acids or proteins of the invention, in various embodiments, by at least about 70%, 80%, or 95% identity (with a preferred identity of 80–95%) over a nucleic acid or amino acid sequence of identical size or when compared to an aligned sequence in which the alignment is done by a computer homology program known in the art, or whose encoding nucleic acid is capable of hybridizing to the complement of a sequence encoding the aforementioned proteins under stringent, moderately stringent, or low stringent conditions. See e.g. Ausubel, et al., CURRENT PROTOCOLS IN MOLECULAR BIOLOGY, John Wiley & Sons, New York, N.Y., 1993, and below.

A "homologous nucleic acid sequence" or "homologous amino acid sequence," or variations thereof, refer to sequences characterized by a homology at the nucleotide level or amino acid level as discussed above. Homologous nucleotide sequences encode those sequences coding for isoforms of NOVX polypeptides. Isoforms can be expressed in different tissues of the same organism as a result of, for example, alternative splicing of RNA. Alternatively, isoforms can be encoded by different genes. In the invention, homologous nucleotide sequences include nucleotide sequences encoding for an NOVX polypeptide of species other than humans, including, but not limited to: vertebrates, and thus can include, e.g., frog, mouse, rat, rabbit, dog, cat cow, horse, and other organisms. Homologous nucleotide sequences also include, but are not limited to, naturally occurring allelic variations and mutations of the nucleotide sequences set forth herein. A homologous nucleotide sequence does not, however, include the exact nucleotide sequence encoding human NOVX protein. Homologous nucleic acid sequences include those nucleic acid sequences that encode conservative amino acid substitutions (see below) in SEQ ID NOS:1, 3, 5, 7, 9, 11, 13, 15, 17, 19, 21, 23, 25, 27, 29, 31, 33, 35, 37, 39, 41, 43, 45, and 197, as well as a polypeptide possessing NOVX biological activity. Various biological activities of the NOVX proteins are described below.

An NOVX polypeptide is encoded by the open reading frame ("ORF") of an NOVX nucleic acid. An ORF corresponds to a nucleotide sequence that could potentially be translated into a polypeptide. A stretch of nucleic acids comprising an ORF is uninterrupted by a stop codon. An ORF that represents the coding sequence for a full protein begins with an ATG "start" codon and terminates with one of the three "stop" codons, namely, TAA, TAG, or TGA. For the purposes of this invention, an ORF may be any part of a coding sequence, with or without a start codon, a stop codon, or both. For an ORF to be considered as a good candidate for coding for a bonafide cellular protein, a minimum size requirement is often set, e.g., a stretch of DNA that would encode a protein of 50 amino acids or more.

The nucleotide sequences determined from the cloning of the human NOVX genes allows for the generation of probes and primers designed for use in identifying and/or cloning NOVX homologues in other cell types, e.g. from other tissues, as well as NOVX homologues from other vertebrates. The probe/primer typically comprises substantially purified oligonucleotide. The oligonucleotide typically comprises a region of nucleotide sequence that hybridizes under stringent conditions to at least about 12, 25, 50, 100, 150, 200, 250, 300, 350 or 400 consecutive sense strand nucleotide sequence SEQ ID NOS:1, 3, 5, 7, 9, 11, 13, 15, 17, 19, 21, 23, 25, 27, 29, 31, 33, 35, 37, 39, 41, 43, 45, or 197; or an anti-sense strand nucleotide sequence of SEQ ID NOS:1, 3, 5, 7, 9, 11, 13, 15, 17, 19, 21, 23, 25, 27, 29, 31, 33, 35, 37, 39, 41, 43, 45, or 197; or of a naturally occurring mutant of SEQ ID NOS 1, 3, 5, 7, 9, 11, 13, 15, 17, 19, 21, 23, 25, 27, 29, 31, 33, 35, 37, 39, 41, 43, 45, and 197.

Probes based on the human NOVX nucleotide sequences can be used to detect transcripts or genomic sequences encoding the same or homologous proteins. In various embodiments, the probe further comprises a label group attached thereto, e.g. the label group can be a radioisotope, a fluorescent compound, an enzyme, or an enzyme co-factor. Such probes can be used as a part of a diagnostic test kit for identifying cells or tissues which mis-express an NOVX protein, such as by measuring a level of an NOVX-encoding nucleic acid in a sample of cells from a subject e.g., detecting NOVX mRNA levels or determining whether a genomic NOVX gene has been mutated or deleted.

"A polypeptide having a biologically-active portion of an NOVX polypeptide" refers to polypeptides exhibiting activity similar, but not necessarily identical to, an activity of a polypeptide of the invention, including mature forms, as measured in a particular biological assay, with or without dose dependency. A nucleic acid fragment encoding a "biologically-active portion of NOVX" can be prepared by isolating a portion SEQ ID NOS:1, 3, 5, 7, 9, 11, 13, 15, 17, 19, 21, 23, 25, 27, 29, 31, 33, 35, 37, 39, 41, 43, 45, or 197, that encodes a polypeptide having an NOVX biological activity (the biological activities of the NOVX proteins are described below), expressing the encoded portion of NOVX protein (e.g., by recombinant expression in vitro) and assessing the activity of the encoded portion of NOVX.

NOVX Nucleic Acid and Polypeptide Variants

The invention further encompasses nucleic acid molecules that differ from the nucleotide sequences shown in SEQ ID NOS:1, 3, 5, 7, 9, 11, 13, 15, 17, 19, 21, 23, 25, 27, 29, 31, 33, 35, 37, 39, 41, 43, 45, and 197 due to degeneracy of the genetic code and thus encode the same NOVX proteins as that encoded by the nucleotide sequences shown in SEQ ID NOS:1, 3, 5, 7, 9, 11, 13, 15, 17, 19, 21, 23, 25, 27, 29, 31, 33, 35, 37, 39, 41, 43, 45, and 197. In another embodiment, an isolated nucleic acid molecule of the invention has a nucleotide sequence encoding a protein having an amino acid sequence shown in SEQ ID NOS:2, 4, 6, 8, 10, 12, 14, 16, 18, 20, 22, 24, 26, 28, 30, 32, 34, 26, 28, 40, 42, 44, 46, or 198.

In addition to the human NOVX nucleotide sequences shown in SEQ ID NOS:1, 3, 5, 7, 9, 11, 13, 15, 17, 19, 21, 23, 25, 27, 29, 31, 33, 35, 37, 39, 41, 43, 45, and 197, it will be appreciated by those skilled in the art that DNA sequence polymorphisms that lead to changes in the amino acid sequences of the NOVX polypeptides may exist within a population (e.g., the human population). Such genetic polymorphism in the NOVX genes may exist among individuals within a population due to natural allelic variation. As used herein, the terms "gene" and "recombinant gene" refer to nucleic acid molecules comprising an open reading frame (ORF) encoding an NOVX protein, preferably a vertebrate NOVX protein. Such natural allelic variations can typically result in 1–5% variance in the nucleotide sequence of the NOVX genes. Any and all such nucleotide variations and resulting amino acid polymorphisms in the NOVX polypeptides, which are the result of natural allelic variation and that do not alter the functional activity of the NOVX polypeptides, are intended to be within the scope of the invention.

Moreover, nucleic acid molecules encoding NOVX proteins from other species, and thus that have a nucleotide sequence that differs from the human SEQ ID NOS:1, 3, 5, 7, 9, 11, 13, 15, 17, 19, 21, 23, 25, 27, 29, 31, 33, 35, 37, 39, 41, 43, 45, and 197 are intended to be within the scope of the invention. Nucleic acid molecules corresponding to natural allelic variants and homologues of the NOVX cDNAs of the invention can be isolated based on their homology to the human NOVX nucleic acids disclosed herein using the human cDNAs, or a portion thereof, as a hybridization probe according to standard hybridization techniques under stringent hybridization conditions.

Accordingly, in another embodiment, an isolated nucleic acid molecule of the invention is at least 6 nucleotides in length and hybridizes under stringent conditions to the nucleic acid molecule comprising the nucleotide sequence of SEQ ID NOS:1, 3, 5, 7, 9, 11, 13, 15, 17, 19, 21, 23, 25, 27, 29, 31, 33, 35, 37, 39, 41, 43, 45, and 197. In another embodiment, the nucleic acid is at least 10, 25, 50, 100, 250, 500, 750, 1000, 1500, or 2000 or more nucleotides in length. In yet another embodiment, an isolated nucleic acid molecule of the invention hybridizes to the coding region. As used herein, the term "hybridizes under stringent conditions" is intended to describe conditions for hybridization and washing under which nucleotide sequences at least 60% homologous to each other typically remain hybridized to each other.

Homologs (ie., nucleic acids encoding NOVX proteins derived from species other than human) or other related sequences (e.g., paralogs) can be obtained by low, moderate or high stringency hybridization with all or a portion of the particular human sequence as a probe using methods well known in the art for nucleic acid hybridization and cloning.

As used herein, the phrase "stringent hybridization conditions" refers to conditions under which a probe, primer or oligonucleotide will hybridize to its target sequence, but to no other sequences. Stringent conditions are sequence-dependent and will be different in different circumstances. Longer sequences hybridize specifically at higher temperatures than shorter sequences. Generally, stringent conditions are selected to be about 5° C. lower than the thermal melting point (Tm) for the specific sequence at a defined ionic strength and pH. The Tm is the temperature (under defined ionic strength, pH and nucleic acid concentration) at which 50% of the probes complementary to the target sequence hybridize to the target sequence at equilibrium. Since the target sequences are generally present at excess, at Tm, 50% of the probes are occupied at equilibrium. Typically, stringent conditions will be those in which the salt concentration is less than about 1.0 M sodium ion, typically about 0.01 to 1.0 M sodium ion (or other salts) at pH 7.0 to 8.3 and the temperature is at least about 30° C. for short probes, primers or oligonucleotides (e.g., 10 nt to 50 nt) and at least about 60° C. for longer probes, primers and oligonucleotides. Stringent conditions may also be achieved with the addition of destabilizing agents, such as formamide.

Stringent conditions are known to those skilled in the art and can be found in Ausubel, et al., (eds.), CURRENT PROTOCOLS IN MOLECULAR BIOLOGY, John Wiley & Sons, N.Y. (1989), 6.3.1–6.3.6. Preferably, the conditions are such that sequences at least about 65%, 70%, 75%, 85%, 90%, 95%, 98%, or 99% homologous to each other typically remain hybridized to each other. A non-limiting example of stringent hybridization conditions are hybridization in a high salt buffer comprising 6×SSC, 50 mM Tris-HCl (pH 7.5), 1 mM EDTA, 0.02% PVP, 0.02% Ficoll, 0.02% BSA, and 500 mg/ml denatured salmon sperm DNA at 65° C., followed by one or more washes in 0.2×SSC, 0.01% BSA at 50° C. An isolated nucleic acid molecule of the invention that hybridizes under stringent conditions to the sequences SEQ ID NOS:1, 3, 5, 7, 9, 11, 13, 15, 17, 19, 21, 23, 25, 27, 29, 31, 33, 35, 37, 39, 41, 43, 45, and 197, corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

In a second embodiment, a nucleic acid sequence that is hybridizable to the nucleic acid molecule comprising the nucleotide sequence of SEQ ID NOS:1, 3, 5, 7, 9, 11, 13, 15, 17, 19, 21, 23, 25, 27, 29, 31, 33, 35, 37, 39, 41, 43, 45, and 197, or fragments, analogs or derivatives thereof, under conditions of moderate stringency is provided. A non-limiting example of moderate stringency hybridization conditions are hybridization in 6×SSC, 5× Denhardt's solution, 0.5% SDS and 100 mg/ml denatured salmon sperm DNA at 55° C., followed by one or more washes in 1×SSC, 0.1% SDS at 37° C. Other conditions of moderate stringency that may be used are well-known within the art. See, e.g., Ausubel, et al. (eds.), 1993, CURRENT PROTOCOLS IN MOLECULAR BIOLOGY, John Wiley & Sons, NY, and Iriegler, 1990; GENE TRANSFER AND EXPRESSION, A LABORATORY MANUAL, Stockton Press, NY.

In a third embodiment, a nucleic acid that is hybridizable to the nucleic acid molecule comprising the nucleotide sequences SEQ ID NOS:1, 3, 5, 7, 9, 11, 13, 15, 17, 19, 21, 23, 25, 27, 29, 31, 33, 35, 37, 39, 41, 43, 45, and 197, or fragments, analogs or derivatives thereof, under conditions of low stringency, is provided. A non-limiting example of low stringency hybridization conditions are hybridization in 35% formamide, 5×SSC, 50 mM Tris-HCl (pH 7.5), 5 mM EDTA, 0.02% PVP, 0.02% Ficoll, 0.2% BSA, 100 mg/ml denatured salmon sperm DNA, 10% (wt/vol) dextran sulfate at 40° C., followed by one or more washes in 2×SSC, 25 mM Tris-HCl (pH 7.4), 5 mM EDTA, and 0.1% SDS at 50° C. Other conditions of low stringency that may be used are well known in the art (e.g., as employed for cross-species hybridizations). See, e.g., Ausubel, et al. (eds.), 1993, CURRENT PROTOCOLS IN MOLECULAR BIOLOGY, John Wiley & Sons, NY, and Kriegler, 1990, GENE TRANSFER AND EXPRESSION, A LABORATORY MANUAL, Stockton Press, NY; Shilo and Weinberg, 1981. Proc Natl Acad Sci USA 78: 6789–6792.

Conservative Mutations

In addition to naturally-occurring allelic variants of NOVX sequences that may exist in the population, the skilled artisan will further appreciate that changes can be introduced by mutation into the nucleotide sequences SEQ ID NOS:1, 3, 5, 7, 9, 11, 13, 15, 17, 19, 21, 23, 25, 27, 29, 31, 33, 35, 37, 39, 41, 43, 45, and 197, thereby leading to changes in the amino acid sequences of the encoded NOVX proteins, without altering the functional ability of said NOVX proteins. For example, nucleotide substitutions leading to amino acid substitutions at "non-essential" amino acid residues can be made in the sequence SEQ ID NOS:2, 4, 6, 8, 10, 12, 14, 16, 18, 20, 22, 24, 26, 28, 30, 32, 34, 26, 28, 40, 42, 44, 46, or 198. A "non-essential" amino acid residue is a residue that can be altered from the wild-type sequences of the NOVX proteins without altering their biological activity, whereas an "essential" amino acid residue is required for such biological activity. For example, amino acid residues that are conserved among the NOVX proteins of the invention are predicted to be particularly non-amenable to alteration. Amino acids for which conservative substitutions can be made are well-known within the art.

Another aspect of the invention pertains to nucleic acid molecules encoding NOVX proteins that contain changes in amino acid residues that are not essential for activity. Such NOVX proteins differ in amino acid sequence from SEQ ID NOS:1, 3, 5, 7, 9, 11, 13, 15, 17, 19, 21, 23, 25, 27, 29, 31, 33, 35, 37, 39, 41, 43, 45, and 197 yet retain biological activity. In one embodiment, the isolated nucleic acid molecule comprises a nucleotide sequence encoding a protein, wherein the protein comprises an amino acid sequence at least about 45% homologous to the amino acid sequences SEQ ID NOS:2, 4, 6, 8, 10, 12, 14, 16, 18, 20, 22, 24, 26, 28, 30, 32, 34, 26, 28, 40, 42, 44, 46, and 198. Preferably, the protein encoded by the nucleic acid molecule is at least about 60% homologous to SEQ ID NOS:2, 4, 6, 8, 10, 12, 14, 16, 18, 20, 22, 24, 26, 28, 30, 32, 34, 26, 28, 40, 42, 44, 46, and 198; more preferably at least about 70% homologous SEQ ID NOS:2, 4, 6, 8, 10, 12, 14, 16, 18, 20, 22, 24, 26, 28, 30, 32, 34, 26, 28, 40, 42, 44, 46, or 198; still more preferably at least about 80% homologous to SEQ ID NOS:2, 4, 6, 8, 10, 12, 14, 16, 18, 20, 22, 24, 26, 28, 30, 32, 34, 26, 28, 40, 42, 44, 46, or 198; even more preferably at least about 90% homologous to SEQ ID NOS:2, 4, 6, 8, 10, 12, 14, 16, 18, 20, 22, 24, 26, 28, 30, 32, 34, 26, 28, 40, 42, 44, 46, or 198; and most preferably at least about 95% homologous to SEQ ID NOS:2, 4, 6, 8, 10, 12, 14, 16, 18, 20, 22, 24, 26, 28, 30, 32, 34, 26, 28, 40, 42, 44, 46, or 198.

An isolated nucleic acid molecule encoding an NOVX protein homologous to the protein of SEQ ID NOS:2, 4, 6, 8, 10, 12, 14, 16, 18, 20, 22, 24, 26, 28, 30, 32, 34, 26, 28, 40, 42, 44, 46, or 198 can be created by introducing one or more nucleotide substitutions, additions or deletions into the nucleotide sequence of SEQ ID NOS:1, 3, 5, 7, 9, 11, 13, 15, 17, 19, 21, 23, 25, 27, 29, 31, 33, 35, 37, 39, 41, 43, 45, and 197, such that one or more amino acid substitutions, additions or deletions are introduced into the encoded protein.

Mutations can be introduced into SEQ ID NOS: 1, 3, 5, 7, 9, 11, 13, 15, 17, 19, 21, 23, 25, 27, 29, 31, 33, 35, 37, 39, 41, 43, 45, and 197 by standard techniques, such as site-directed mutagenesis and PCR-mediated mutagenesis. Preferably, conservative amino acid substitutions are made at one or more predicted, non-essential amino acid residues. A "conservative amino acid substitution" is one in which the amino acid residue is replaced with an amino acid residue having a similar side chain. Families of amino acid residues having similar side chains have been defined within the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted non-essential amino acid residue in the NOVX protein is replaced with another amino acid residue from the same side chain family. Alternatively, in another embodiment, mutations can be introduced randomly along all or part of an NOVX coding sequence, such as by saturation mutagenesis, and the resultant mutants can be screened for NOVX biological activity to identify mutants that retain activity. Following mutagenesis SEQ ID NOS:1, 3, 5, 7, 9, 11, 13, 15, 17, 19, 21, 23, 25, 27, 29, 31, 33, 35, 37, 39, 41, 43, 45, and 197, the encoded protein can be expressed by any recombinant technology known in the art and the activity of the protein can be determined.

The relatedness of amino acid families may also be determined based on side chain interactions. Substituted amino acids may be fully conserved "strong" residues or fully conserved "weak" residues. The "strong" group of conserved amino acid residues may be any one of the following groups: STA, NEQK, NHQK, NDEQ, QHRK, MILV, MILF, HY, FYW, wherein the single letter amino acid codes are grouped by those amino acids that may be substituted for each other. Likewise, the "weak" group of conserved residues may be any one of the following: CSA, ATV, SAG, STNK, STPA, SGND, SNDEQK, NDEQHK, NEQHRK, VLIM, HFY, wherein the letters within each group represent the single letter amino acid code.

In one embodiment, a mutant NOVX protein can be assayed for (i) the ability to form protein:protein interactions with other NOVX proteins, other cell-surface proteins, or biologically-active portions thereof, (ii) complex formation between a mutant NOVX protein and an NOVX ligand; or (ii) the ability of a mutant NOVX protein to bind to an intracellular target protein or biologically-active portion thereof; (e.g. avidin proteins).

In yet another embodiment, a mutant NOVX protein can be assayed for the ability to regulate a specific biological function (e.g., regulation of insulin release).

Antisense Nucleic Acids

Another aspect of the invention pertains to isolated antisense nucleic acid molecules that are hybridizable to or complementary to the nucleic acid molecule comprising the nucleotide sequence of SEQ ID NOS:1, 3, 5, 7, 9, 11, 13, 15, 17, 19, 21, 23, 25, 27, 29, 31, 33, 35, 37, 39, 41, 43, 45, and 197, or fragments, analogs or derivatives thereof. An "antisense" nucleic acid comprises a nucleotide sequence that is complementary to a "sense" nucleic acid encoding a protein (e.g., complementary to the coding strand of a double-stranded cDNA molecule or complementary to an mRNA sequence). In specific aspects, antisense nucleic acid molecules are provided that comprise a sequence complementary to at least about 10, 25, 50, 100, 250 or 500 nucleotides or an entire NOVX coding strand, or to only a portion thereof. Nucleic acid molecules encoding fragments, homologs, derivatives and analogs of an NOVX protein of SEQ ID NOS:2, 4, 6, 8, 10, 12, 14, 16, 18, 20, 22, 24, 26, 28, 30, 32, 34, 26, 28, 40, 42, 44, 46, or 198, or antisense nucleic acids complementary to an NOVX nucleic acid sequence of SEQ ID NOS:1, 3, 5, 7, 9, 11, 13, 15, 17, 19, 21, 23, 25, 27, 29, 31, 33, 35, 37, 39, 41, 43, 45, and 197, are additionally provided.

In one embodiment, an antisense nucleic acid molecule is antisense to a "coding region" of the coding strand of a nucleotide sequence encoding an NOVX protein. The term "coding region" refers to the region of the nucleotide sequence comprising codons which are translated into amino acid residues. In another embodiment, the antisense nucleic acid molecule is antisense to a "noncoding region" of the coding strand of a nucleotide sequence encoding the NOVX protein. The term "noncoding region" refers to 5' and 3' sequences which flank the coding region that are not translated into amino acids (i.e., also referred to as 5' and 3' untranslated regions).

Given the coding strand sequences encoding the NOVX protein disclosed herein, antisense nucleic acids of the invention can be designed according to the rules of Watson and Crick or Hoogsteen base pairing. The antisense nucleic acid molecule can be complementary to the entire coding region of NOVX mRNA, but more preferably is an oligonucleotide that is antisense to only a portion of the coding or noncoding region of NOVX mRNA. For example, the antisense oligonucleotide can be complementary to the region surrounding the translation start site of NOVX mRNA. An antisense oligonucleotide can be, for example, about 5, 10, 15, 20, 25, 30, 35, 40, 45 or 50 nucleotides in length. An antisense nucleic acid of the invention can be constructed using chemical synthesis or enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids (e.g., phosphorothioate derivatives and acridine substituted nucleotides can be used).

Examples of modified nucleotides that can be used to generate the antisense nucleic acid include: 5-fluorouracil, 5-bromouracil, S-chlorouracil, 5-iodouracil, hypoxanthine, xanthine, 4-acetylcytosine, 5-(carboxyhydroxylmethyl) uracil, 5-carboxymethylaminomethyl-=2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-mcthoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 33-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding an NOVX protein to thereby inhibit expression of the protein (e.g., by inhibiting transcription and/or translation). The hybridization can be by conventional nucleotide complementarity to form a stable duplex, or, for example, in the case of an antisense nucleic acid molecule that binds to DNA duplexes, through specific interactions in the major groove of the double helix. An example of a route of administration of antisense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface (e.g., by linking the antisense nucleic acid molecules to peptides or antibodies that bind to cell surface receptors or antigens). The antisense nucleic acid molecules can also be delivered to cells using the vectors described herein. To achieve sufficient nucleic acid molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual Funits, the strands run parallel to each other. See, e.g., Gaultier, et al., 1987. *Nucl. Acids Res.* 15: 6625–6641. The antisense nucleic acid molecule can also comprise a 2'-o-methylribonucleotide (See, e.g., Inoue, et al. 1987. *Nucl. Acids Res.* 15: 6131–6148) or a chimeric RNA-DNA analogue (See, e.g., Inoue, et al., 1987. *FEBS Lett.* 215: 327–330.

Ribozymes and PNA Moieties

Nucleic acid modifications include, by way of non-limiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject.

In one embodiment, an antisense nucleic acid of the invention is a ribozyme. Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes as described in Haselhoff and Gerlach 1988. Nature 334: 585–591) can be used to catalytically cleave NOVX mRNA transcripts to thereby inhibit translation of NOVX mRNA. A ribozyme having specificity for an NOVX-encoding nucleic acid can be designed based upon the nucleotide sequence of an NOVX cDNA disclosed herein (i.e., SEQ ID NOS:1, 3, 5, 7, 9, 11, 13, 15, 17, 19, 21, 23, 25, 27, 29, 31, 33, 35, 37, 39, 41, 43, 45, and 197). For example, a derivative of a *Tetrahymena* L-19 IVS RNA can be constructed in which the nucleotide sequence of the active site is complementary to the nucleotide sequence to be cleaved in an NOVX-encoding mRNA. See, e.g., U.S. Pat. No. 4,987,071 to Cech, et al., and U.S. Pat. No. 5,116,742 to Cech, et al. NOVX mRNA can also be used to select a catalytic RNA having a specific ribonuclease activity from a pool of RNA molecules. See, e.g., Bartel et al., (1993) *Science* 261:1411–1418.

Alternatively, NOVX gene expression can be inhibited by targeting nucleotide sequences complementary to the regulatory region of the NOVX nucleic acid (e.g., the NOVX promoter and/or enhancers) to form triple helical structures that prevent transcription of the NOVX gene in target cells. See, e.g., Helene, 1991. *Anticancer Drug Des.* 6: 569–84; Helene, et al. 1992. *Ann. N.Y. Acad. Sci.* 660: 27–36; Maher, 1992. *Bioassays* 14: 807–15.

In various embodiments, the NOVX nucleic acids can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids. See, e.g., Hyrup, et al., 1996. *Bioorg Med Chem* 4: 5–23. As used herein, the terms "peptide nucleic acids" or "PNAs" refer to nucleic acid mimics (e.g., DNA mimics) in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup, et al., 1996, supra; Perry-O'Keefe, et al., 1996. *Proc. Natl. Acad. Sci. USA* 93: 14670–14675.

PNAs of NOVX can be used in therapeutic and diagnostic applications. For example, PNAs can be used as antisense or antigene agents for sequence-specific modulation of gene expression by, e.g., inducing transcription or translation arrest or inhibiting replication. PNAs of NOVX can also be used, for example, in the analysis of single base pair mutations in a gene (e.g., PNA directed PCR clamping; as artificial restriction enzymes when used in combination with other enzymes, e.g., S1 nucleases (See, Hyrup, et al., 1996, supra); or as probes or primers for DNA sequence and hybridization (See, Hyrup, et al., 1996, supra; Perry-O'Keefe, et al., 1996, supra).

In another embodiment, PNAs of NOVX can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras of NOVX can be generated that may combine the advantageous properties of PNA and DNA. Such chimeras allow DNA recognition enzymes (e.g., RNase H and DNA polymerases) to interact with the DNA portion while the PNA portion would provide high binding affinity and specificity. PNA-DNA chimeras can be linked using linkers of appropriate lengths selected in terms of base stacking, number of bonds between the nucleobases, and orientation (see, Hyrup, et al., 1996, supra). The synthesis of PNA-DNA chimeras can be performed as described in Hyrup, et al., 1996. supra and Finn, et al., 1996. *Nucl Acids Res* 24: 3357–3363. For example, a DNA chain can be synthesized on a solid support using standard phosphoramidite coupling chemistry, and modified nucleoside analogs, e.g., 5'-(4-methoxytrityl)amino-5'-deoxy-thymidine phosphoramidite, can be used between the PNA and the 5' end of DNA. See, e.g., Mag, et al., 1989. *Nucl Acid Res* 17: 5973–5988. PNA monomers are then coupled in a stepwise manner to produce a chimeric molecule with a 5' PNA segment and a 3' DNA segment. See, e.g., Finn, et al., 1996. supra. Alternatively, chimeric molecules can be synthesized with a 5' DNA segment and a 3' PNA segment. See, e.g., Petersen, et al., 1975. Bioorg. Med. Chem. Lett. 5: 1119–11124.

In other embodiments, the oligonucleotide may include other appended groups such as peptides (e.g., for targeting host cell receptors in vivo), or agents facilitating transport across the cell membrane (see, e.g., Letsinger, et al., 1989. *Proc. Natl. Acad. Sci. U.S.A.* 86: 6553–6556; Lemaitre, et al., 1987. *Proc. Natl. Acad. Sci.* 84: 648–652; PCT Publication No. WO88/09810) or the blood-brain barrier (see, e.g., PCT Publication No. WO 89/10134). In addition, oligonucleotides can be modified with hybridization triggered cleavage agents (see, e.g., Krol, et al., 1988. *BioTechniques* 6:958–976) or intercalating agents (see e.g., Zon, 1988. *Pharm. Res.* 5: 539–549). To this end, the oligonucleotide may be conjugated to another molecule, e.g., a peptide, a hybridization triggered cross-linking agent, a transport agent, a hybridization-triggered cleavage agent, and the like.

NOVX Polypeptides

A polypeptide according to the invention includes a polypeptide including the amino acid sequence of NOVX polypeptides whose sequences are provided in SEQ ID NOS:2, 4, 6, 8, 10, 12, 14, 16, 18, 20, 22, 24, 26, 28, 30, 32, 34, 26, 28, 40, 42, 44, 46, or 198. The invention also includes a mutant or variant protein any of whose residues may be changed from the corresponding residues shown in SEQ ID NOS:2, 4, 6, 8, 10, 12, 14, 16, 18, 20, 22, 24, 26, 28, 30, 32, 34, 26, 28, 40, 42, 44, 46, or 198 while still encoding a protein that maintains its NOVX activities and physiological functions, or a functional fragment thereof.

In general, an NOVX variant that preserves NOVX-like function includes any variant in which residues at a particular position in the sequence have been substituted by other amino acids, and further include the possibility of inserting an additional residue or residues between two residues of the parent protein as well as the possibility of deleting one or more residues from the parent sequence. Any amino acid substitution, insertion, or deletion is encompassed by the invention. In favorable circumstances, the substitution is a conservative substitution as defined above.

One aspect of the invention pertains to isolated NOVX proteins, and biologically-active portions thereof, or derivatives, fragments, analogs or homologs thereof. Also provided are polypeptide fragments suitable for use as immunogens to raise anti-NOVX antibodies. In one embodiment, native NOVX proteins can be isolated from cells or tissue sources by an appropriate purification scheme using standard protein purification techniques. In another embodiment, NOVX proteins are produced by recombinant DNA techniques. Alternative to recombinant expression, an NOVX protein or polypeptide can be synthesized chemically using standard peptide synthesis techniques.

An "isolated" or "purified" polypeptide or protein or biologically-active portion thereof is substantially free of cellular material or other contaminating proteins from the cell or tissue source from which the NOVX protein is derived, or substantially free from chemical precursors or other chemicals when chemically synthesized. The language "substantially free of cellular material" includes preparations of NOVX proteins in which the protein is separated from cellular components of the cells from which it is isolated or recombinantly-produced. In one embodiment, the language "substantially free of cellular material" includes preparations of NOVX proteins having less than about 30% (by dry weight) of non-NOVX proteins (also referred to herein as a "contaminating protein"), more preferably less than about 20% of non-NOVX proteins, still more preferably less than about 10% of non-NOVX proteins, and most preferably less than about 5% of non-NOVX proteins. When the NOVX protein or biologically-active portion thereof is recombinantly-produced, it is also preferably substantially free of culture medium, i.e., culture medium represents less than about 20%, more preferably less than about 10%, and most preferably less than about 5% of the volume of the NOVX protein preparation.

The language "substantially free of chemical precursors or other chemicals" includes preparations of NOVX proteins in which the protein is separated from chemical precursors or other chemicals that are involved in the synthesis of the protein. In one embodiment, the language "substantially free of chemical precursors or other chemicals" includes preparations of NOVX proteins having less than about 30% (by dry weight) of chemical precursors or non-NOVX chemicals, more preferably less than about 20% chemical precursors or non-NOVX chemicals, still more preferably less than about 10% chemical precursors or non-NOVX chemicals, and most preferably less than about 5% chemical precursors or non-NOVX chemicals.

Biologically-active portions of NOVX proteins include peptides comprising amino acid sequences sufficiently homologous to or derived from the amino acid sequences of the NOVX proteins (e.g., the amino acid sequence shown in SEQ ID NOS:2, 4, 6, 8, 10, 12, 14, 16, 18, 20, 22, 24, 26, 28, 30, 32, 34, 26, 28, 40, 42, 44, 46, or 198) that include fewer amino acids than the full-length NOVX proteins, and exhibit at least one activity of an NOVX protein. Typically, biologically-active portions comprise a domain or motif with at least one activity of the NOVX protein. A biologically-active portion of an NOVX protein can be a polypeptide which is, for example, 10, 25, 50, 100 or more amino acid residues in length.

Moreover, other biologically-active portions, in which other regions of the protein are deleted, can be prepared by recombinant techniques and evaluated for one or more of the functional activities of a native NOVX protein.

In an embodiment, the NOVX protein has an amino acid sequence shown SEQ ID NOS:2, 4, 6, 8, 10, 12, 14, 16, 18, 20, 22, 24, 26, 28, 30, 32, 34, 26, 28, 40, 42, 44, 46, or 198. In other embodiments, the NOVX protein is substantially homologous to SEQ ID NOS:2, 4, 6, 8, 10, 12, 14, 16, 18, 20, 22, 24, 26, 28, 30, 32, 34, 26, 28, 40, 42, 44, 46, or 198, and retains the functional activity of the protein of SEQ ID NOS:2, 4, 6, 8, 10, 12, 14, 16, 18, 20, 22, 24, 26, 28, 30, 32, 34, 26, 28, 40, 42, 44, 46, or 198, yet differs in amino acid sequence due to natural allelic variation or mutagenesis, as described in detail, below. Accordingly, in another embodiment, the NOVX protein is a protein that comprises an amino acid sequence at least about 45% homologous to the amino acid sequence SEQ ID NOS:2, 4, 6, 8, 10, 12, 14, 16, 18, 20, 22, 24, 26, 28, 30, 32, 34, 26, 28, 40, 42, 44, 46, or 198, and retains the functional activity of the NOVX proteins of SEQ ID NOS:2, 4, 6, 8, 10, 12, 14, 16, 18, 20, 22, 24, 26, 28, 30, 32, 34, 26, 28, 40, 42, 44, 46, or 198.

Determining Homology Between Two or More Sequences

To determine the percent homology of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are homologous at that position (ie., as used herein amino acid or nucleic acid "homology" is equivalent to amino acid or nucleic acid "identity").

The nucleic acid sequence homology may be determined as the degree of identity between two sequences. The homology may be determined using computer programs known in the art, such as GAP software provided in the GCG program package. See, Needleman and Wunsch, 1970. *J Mol Biol* 48: 443–453. Using GCG GAP software with the following settings for nucleic acid sequence comparison: GAP creation penalty of 5.0 and GAP extension penalty of 0.3, the coding region of the analogous nucleic acid sequences referred to above exhibits a degree of identity preferably of at least 70%, 75%, 80%, 85%, 90%, 95%, 98%, or 99%, with the CDS (encoding) part of the DNA sequence shown in SEQ ID NOS:1, 3, 5, 7, 9, 11, 13, 15, 17, 19, 21, 23, 25, 27, 29, 31, 33, 35, 37, 39, 41, 43, 45, and 197.

The term "sequence identity" refers to the degree to which two polynucleotide or polypeptide sequences are identical on a residue-by-residue basis over a particular region of comparison. The term "percentage of sequence identity" is calculated by comparing two optimally aligned sequences over that region of comparison, determining the number of positions at which the identical nucleic acid base (e.g., A, T, C, G, U, or I, in the case of nucleic acids) occurs in both sequences to yield the number of matched positions, dividing the number of matched positions by the total number of positions in the region of comparison (i.e., the window size), and multiplying the result by 100 to yield the percentage of sequence identity. The term "substantial identity" as used herein denotes a characteristic of a polynucleotide sequence, wherein the polynucleotide comprises a sequence that has at least 80 percent sequence identity, preferably at least 85 percent identity and often 90 to 95 percent sequence identity, more usually at least 99 percent sequence identity as compared to a reference sequence over a comparison region.

Chimeric and Fusion Proteins

The invention also provides NOVX chimeric or fusion proteins. As used herein, an NOVX "chimeric protein" or "fusion protein" comprises an NOVX polypeptide operatively-linked to a non-NOVX polypeptide. An "NOVX polypeptide" refers to a polypeptide having an amino acid sequence corresponding to an NOVX protein SEQ ID NOS:2, 4, 6, 8, 10, 12, 14, 16, 18, 20, 22, 24, 26, 28, 30, 32, 34, 26, 28, 40, 42, 44, 46, or 198, whereas a "non-NOVX polypeptide" refers to a polypeptide having an amino acid sequence corresponding to a protein that is not substantially homologous to the NOVX protein, e.g., a protein that is different from the NOVX protein and that is derived from the same or a different organism. Within an NOVX fusion protein the NOVX polypeptide can correspond to all or a portion of an NOVX protein. In one embodiment, an NOVX fusion protein comprises at least one biologically-active portion of an NOVX protein. In another embodiment, an NOVX fusion protein comprises at least two biologically-active portions of an NOVX protein. In yet another embodiment, an NOVX fusion protein comprises at least three biologically-active portions of an NOVX protein. Within the fusion protein, the term "operatively-linked" is intended to indicate that the NOVX polypeptide and the non-NOVX polypeptide are fused in-frame with one another. The non-NOVX polypeptide can be fused to the N-terminus or C-terminus of the NOVX polypeptide.

In one embodiment, the fusion protein is a GST-NOVX fusion protein in which the NOVX sequences are fused to the C-terminus of the GST (glutathione S-transferase) sequences. Such fusion proteins can facilitate the purification of recombinant NOVX polypeptides.

In another embodiment, the fusion protein is an NOVX protein containing a heterologous signal sequence at its N-terminus. In certain host cells (e.g., mammalian host cells), expression and/or secretion of NOVX can be increased through use of a heterologous signal sequence.

In yet another embodiment, the fusion protein is an NOVX-immunoglobulin fusion protein in which the NOVX sequences are fused to sequences derived from a member of the immunoglobulin protein family. The NOVX-immunoglobulin fusion proteins of the invention can be incorporated into pharmaceutical compositions and administered to a subject to inhibit an interaction between an NOVX ligand and an NOVX protein on the surface of a cell, to thereby suppress NOVX-mediated signal transduction in vivo. The NOVX-immunoglobulin fusion proteins can be used to affect the bioavailability of an NOVX cognate ligand. Inhibition of the NOVX ligand/NOVX interaction may be useful therapeutically for both the treatment of proliferative and differentiative disorders, as well as modulating (e.g. promoting or inhibiting) cell survival. Moreover, the NOVX-immunoglobulin fusion proteins of the invention can be used as immunogens to produce anti-NOVX antibodies in a subject, to purify NOVX ligands, and in screening assays to identify molecules that inhibit the interaction of NOVX with an NOVX ligand.

An NOVX chimeric or fusion protein of the invention can be produced by standard recombinant DNA techniques. For example, DNA fragments coding for the different polypeptide sequences are ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel, et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). An NOVX-encoding nucleic acid can be cloned into such an expression vector such that the fusion moiety is linked in-frame to the NOVX protein.

NOVX Agonists and Antagonists

The invention also pertains to variants of the NOVX proteins that function as either NOVX agonists (i.e., mimetics) or as NOVX antagonists. Variants of the NOVX protein can be generated by mutagenesis (e.g., discrete point mutation or truncation of the NOVX protein). An agonist of the NOVX protein can retain substantially the same, or a subset of, the biological activities of the naturally occurring form of the NOVX protein. An antagonist of the NOVX protein can inhibit one or more of the activities of the naturally occurring form of the NOVX protein by, for example, competitively binding to a downstream or upstream member of a cellular signaling cascade which includes the NOVX protein. Thus, specific biological effects can be elicited by treatment with a variant of limited function. In one embodiment, treatment of a subject with a variant having a subset of the biological activities of the naturally occurring form of the protein has fewer side effects in a subject relative to treatment with the naturally occurring form of the NOVX proteins.

Variants of the NOVX proteins that function as either NOVX agonists (i.e., mimetics) or as NOVX antagonists can be identified by screening combinatorial libraries of mutants (e.g., truncation mutants) of the NOVX proteins for NOVX protein agonist or antagonist activity. In one embodiment, a variegated library of NOVX variants is generated by combinatorial mutagenesis at the nucleic acid level and is encoded by a variegated gene library. A variegated library of NOVX variants can be produced by, for example, enzymatically ligating a mixture of synthetic oligonucleotides into gene sequences such that a degenerate set of potential NOVX sequences is expressible as individual polypeptides, or alternatively, as a set of larger fusion proteins (e.g., for phage display) containing the set of NOVX sequences therein. There are a variety of methods which can be used to produce libraries of potential NOVX variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential NOVX sequences. Methods for synthesizing degenerate oligonucleotides are well-known within the art. See, e.g., Narang, 1983. *Tetrahedron* 39: 3; Itakura, et al., 1984. *Annu. Rev. Biochem.* 53: 323; Itakura, et al., 1984. *Science* 198: 1056; Ike, et al., 1983. *Nucl. Acids Res.* 111: 477.

Polypeptide Libraries

In addition, libraries of fragments of the NOVX protein coding sequences can be used to generate a variegated population of NOVX fragments for screening and subsequent selection of variants of an NOVX protein. In one embodiment, a library of coding sequence fragments can be generated by treating a double stranded PCR fragment of an NOVX coding sequence with a nuclease under conditions wherein nicking occurs only about once per molecule, denaturing the double stranded DNA, renaturing the DNA to form double-stranded DNA that can include sense/antisense pairs from different nicked products, removing single stranded portions from reformed duplexes by treatment with $S_1$ nuclease, and ligating the resulting fragment library into an expression vector. By this method, expression libraries can be derived which encodes N-terminal and internal fragments of various sizes of the NOVX proteins.

Various techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of NOVX proteins. The most widely used techniques, which are amenable to high throughput analysis, for screening large gene libraries typically include cloning the gene library into replicable expression vectors, transforming appropriate cells with the resulting library of vectors, a nd expressing the combinatorial genes under conditions in which detection of a desired activity facilitates isolation of the vector encoding the gene whose product was detected. Recursive ensemble mutagenesis (REM), a new technique that enhances the frequency of functional mutants in the libraries, can be used in combination with the screening assays to identify NOVX variants. See, e.g., Arkin and Yourvan, 1992. *Proc. Natl. Acad. Sci. USA* 89: 7811–7815; Delgrave, et al., 1993. *Protein Engineering* 6:327–331.

NOVX Antibodies

The term "antibody" as used herein refers to immunoglobulin molecules and immunologically active portions of immunoglobulin (Ig) molecules, i.e., molecules that contain an antigen binding site that specifically binds (immunoreacts with) an antigen. Such antibodies include, but are not limited to, polyclonal, monoclonal, chimeric, single chain, $F_{ab}$, $F_{ab'}$ and $F_{(ab')2}$ fragments, and an $F_{ab}$ expression library. In general, antibody molecules obtained from humans relates to any of the classes IgG, IgM, IgA, IgE and IgD, which differ from one another by the nature of the heavy chain present in the molecule. Certain classes have subclasses as well, such as $IgG_1$, $IgG_2$, and others. Furthermore, in humans, the light chain may be a kappa chain or a lambda chain. Reference herein to antibodies includes a reference to all such classes, subclasses and types of human antibody species.

An isolated protein of the invention intended to serve as an antigen, or a portion or fragment thereof, can be used as an immunogen to generate antibodies that immunospecifically bind the antigen, using standard techniques for polyclonal and monoclonal antibody preparation. The full-length protein can be used or, alternatively, the invention provides antigenic peptide fragments of the antigen for use as immunogens. An antigenic peptide fragment comprises at least 6 amino acid residues of the amino acid sequence of the full length protein, such as an amino acid sequence shown in SEQ ID NOs: 2, 4, 6, 8, 10, 12, 14, 16, 18, 20, 22, 24, 26, 28, 30, 32, 34, 26, 28, 40, 42, 44, 46, and 198, and encompasses an epitope thereof such that an antibody raised against the peptide forms a specific immune complex with the fill length protein or with any fragment that contains the epitope. Preferably, the antigenic peptide comprises at least 10 amino acid residues, or at least 15 amino acid residues, or at least 20 amino acid residues, or at least 30 amino acid residues. Preferred epitopes encompassed by the antigenic peptide are regions of the protein that are located on its surface; commonly these are hydrophilic regions. In certain embodiments of the invention, at least one epitope encompassed by the antigenic peptide is a region of NOVX that is located on the surface of the protein, e.g., a hydrophilic region. A hydrophobicity analysis of the human NOVX protein sequence will indicate which regions of a NOVX polypeptide are particularly hydrophilic and, therefore, are likely to encode surface residues useful for targeting antibody production. As a means for targeting antibody production, hydropathy plots showing regions of hydrophilicity and hydrophobicity may be generated by any method well known in the art, including, for example, the Kyte Doolittle or the Hopp Woods methods, either with or without Fourier transformation. See, e.g., Hopp and Woods, 1981, *Proc. Nat. Acad. Sci. USA* 78: 3824–3828; Kyte and Doolittle 1982, *J. Mol. Biol.* 157: 105–142, each incorporated herein by reference in their entirety. Antibodies that are specific for one or more domains within an antigenic protein, or derivatives, fragments, analogs or homologs thereof, are also provided herein.

A protein of the invention, or a derivative, fragment, analog, homolog or ortholog thereof, may be utilized as an immunogen in the generation of antibodies that immunospecifically bind these protein components.

Various procedures known within the art may be used for the production of polyclonal or monoclonal antibodies directed against a protein of the invention, or against derivatives, fragments, analogs homologs or orthologs thereof (see, for example, Antibodies: A Laboratory Manual, Harlow E, and Lane D, 1988, Cold Spring Harbor Laboratory Press, Cold Spring Harbor, N.Y., incorporated herein by reference). Some of these antibodies are discussed below.

Polyclonal Antibodies

For the production of polyclonal antibodies, various suitable host animals (e.g., rabbit, goat, mouse or other mammal) may be immunized by one or more injections with the native protein, a synthetic variant thereof, or a derivative of the foregoing. An appropriate immunogenic preparation can contain, for example, the naturally occurring immunogenic protein, a chemically synthesized polypeptide representing the immunogenic protein, or a recombinantly expressed immunogenic protein. Furthermore, the protein may be conjugated to a second protein known to be immunogenic in the mammal being immunized. Examples of such immunogenic proteins include but are not limited to keyhole limpet hemocyanin, serum albumin, bovine thyroglobulin, and soybean trypsin inhibitor. The preparation can further include an adjuvant. Various adjuvants used to increase the immunological response include, but are not limited to, Freund's (complete and incomplete), mineral gels (e.g., aluminum hydroxide), surface active substances (e.g., lysolecithin, pluronic polyols, polyanions, peptides, oil emulsions, dinitrophenol, etc.), adjuvants usable in humans such as Bacille Calmette-Guerin and *Corynebacterium parvum*, or similar immunostimulatory agents. Additional examples of adjuvants which can be employed include MPL-TDM adjuvant (monophosphoryl Lipid A, synthetic trehalose dicorynomycolate).

The polyclonal antibody molecules directed against the immunogenic protein can be isolated from the mammal (e.g., from the blood) and further purified by well known techniques, such as affinity chromatography using protein A or protein G, which provide primarily the IgG fraction of immune serum. Subsequently, or alternatively, the specific antigen which is the target of the immunoglobulin sought, or an epitope thereof, may be immobilized on a column to purify the immune specific antibody by immunoaffinity chromatography. Purification of immunoglobulins is discussed, for example, by D. Wilkinson (The Scientist, published by The Scientist, Inc., Philadelphia Pa., Vol. 14, No. 8 (Apr. 17, 2000), pp. 25–28).

Monoclonal Antibodies

The term "monoclonal antibody" (MAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs thus contain an antigen binding site capable of immunoreacting with a particular epitope of the antigen characterized by a unique binding affinity for it.

Monoclonal antibodies can be prepared using hybridoma methods, such as those described by Kohler and Milstein, *Nature*, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes can be immunized in vitro.

The immunizing agent will typically include the protein antigen, a fragment thereof or a fusion protein thereof. Generally, either peripheral blood lymphocytes are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell [Goding, *Monoclonal Antibodies: Principles and Practice*, Academic Press, (1986) pp. 59–103]. Immortalized cell lines are usually transformed mammalian cells, particularly myeloma cells of rodent, bovine and human origin. Usually, rat or mouse myeloma cell lines are employed. The hybridoma cells can be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies [Kozbor, *J. Immunol.*, 133:3001 (1984); Brodeur et al., *Monoclonal Antibody Production Techniques and Applications*, Marcel Dekker, Inc., New York, (1987) pp. 51–63].

The culture medium in which the hybridoma cells are cultured can then be assayed for the presence of monoclonal antibodies directed against the antigen. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.*, 107:220 (1980). It is an objective, especially important in therapeutic applications of monoclonal antibodies, to identify antibodies having a high degree of specificity and a high binding affinity for the target antigen.

After the desired hybridoma cells are identified, the clones can be subcloned by limiting dilution procedures and grown by standard methods (Goding, 1986). Suitable culture media for this purpose include, for example, Dulbecco's Modified Eagle's Medium and RPMI-1640 medium. Alternatively, the hybridoma cells can be grown in vivo as ascites in a mammal.

The monoclonal antibodies secreted by the subclones can be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies can also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA can be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also can be modified, for example, by substituting the coding sequence for human heavy and light chain constant domains in place of the homologous murine sequences (U.S. Pat. No. 4,816,567; Morrison, *Nature* 368, 812–13 (1994)) or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

Humanized Antibodies

The antibodies directed against the protein antigens of the invention can further comprise humanized antibodies or human antibodies. These antibodies are suitable for administration to humans without engendering an immune response by the human against the administered immunoglobulin. Humanized forms of antibodies are chimeric immunoglobulins, immunoglobulin chains or fragments thereof (such as Fv, Fab, Fab', F(ab')$_2$ or other antigen-binding subsequences of antibodies) that are principally comprised of the sequence of a human immunoglobulin, and contain minimal sequence derived from a non-human immunoglobulin. Humanization can be performed following the method of Winter and co-workers (Jones et al., *Nature*, 321:522–525 (1986); Riechmann et al., *Nature*, 332:323–327 (1988); Verhoeyen et al., *Science*, 239:1534–1536 (1988)), by substituting rodent CDRs or CDR sequences for the corresponding sequences of a human antibody. (See also U.S. Pat. No. 5,225,539.) In some instances, Fv framework residues of the human immunoglobulin are replaced by corresponding non-human residues. Humanized antibodies can also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the framework regions are those of a human immunoglobulin consensus sequence. The humanized antibody optimally also will comprise at least a portion of an immunoglobulin constant region (Fc), typically that of a human immunoglobulin (Jones et al., 1986; Riechmann et al., 1988; and Presta, *Curr Op. Struct. Biol.*, 2:593–596 (1992)).

Human Antibodies

Fully human antibodies essentially relate to antibody molecules in which the entire sequence of both the light chain and the heavy chain, including the CDRs, arise from human genes. Such antibodies are termed "human antibodies", or "fully human antibodies" herein. Human monoclonal antibodies can be prepared by the trioma technique; the human Bell hybridoma technique (see Kozbor, et al., 1983 Immunol Today 4: 72) and the EBV hybridoma technique to produce human monoclonal antibodies (see Cole, et al., 1985 In: MONOCLONAL ANTIBODIES AND CANCER THERAPY, Alan R. Liss, Inc., pp. 77–96). Human monoclonal antibodies may be utilized in the practice of the present invention and may be produced by using human hybridomas (see Cote, et al., 1983. *Proc Natl Acad Sci USA* 80: 2026–2030) or by transforming human B-cells with Epstein Barr Virus in vitro (see Cole, et al., 1985 In: MONOCLONAL ANTIBODIES AND CANCER THERAPY, Alan R. Liss, Inc., pp. 77–96).

In addition, human antibodies can also be produced using additional techniques, including phage display libraries (Hoogenboom and Winter, *J. Mol. Biol.*, 227:381 (1991); Marks et al., *J. Mol. Biol.*, 222:581 (1991)). Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545, 806; 5,569,825; 5,625,126; 5,633,425; 5,661,016, and in Marks et al., (*Bio/Technology* 10, 779–783 (1992)); Lonberg et al. *Nature* 368 856–859 (1994)); Morrison (*Nature* 368, 812–13 (1994)); Fishwild et al; (*Nature Biotechnology* 14, 845–51 (1996)); Neuberger (*Nature Biotechnology* 14, 826 (1996)); and Lonberg and Huszar (*Intern. Rev. Immunol.* 13 65–93 (1995)). Human antibodies may additionally be produced using transgenic nonhuman animals which are modified so as to produce fully human antibodies rather than the animal's endogenous antibodies in response to challenge by an antigen. (See PCT publication WO94/02602). The endogenous genes encoding the heavy and light immunoglobulin chains in the nonhuman host have been incapacitated, and active loci encoding human heavy and light chain immunoglobulins are inserted into the host's genome. The human genes are incorporated, for example, using yeast artificial chromosomes containing the requisite human DNA segments. An animal which provides all the desired modifications is then obtained as progeny by crossbreeding intermediate transgenic animals containing fewer than the full complement of the modifications. The preferred embodiment of such a nonhuman animal is a mouse, and is termed the Xenomouse™ as disclosed in PCT publications WO 96/33735 and WO 96/34096. This animal produces B cells which secrete fully human immunoglobulins. The antibodies can be obtained directly from the animal after immunization with an immunogen of interest, as, for example, a preparation of a polyclonal antibody, or alternatively from immortalized B cells derived from the animal, such as hybridomas producing monoclonal antibodies. Additionally, the genes encoding the immunoglobulins with human variable regions can be recovered and expressed to obtain the antibodies directly, or can be further modified to obtain analogs of antibodies such as, for example, single chain Fv molecules.

An example of a method of producing a nonhuman host, exemplified as a mouse, lacking expression of an endogenous immunoglobulin heavy chain is disclosed in U.S. Pat. No. 5,939,598. It can be obtained by a method including deleting the J segment genes from at least one endogenous heavy chain locus in an embryonic stem cell to prevent rearrangement of the locus and to prevent formation of a transcript of a rearranged immunoglobulin heavy chain locus, the deletion being effected by a targeting vector containing a gene encoding a selectable marker, and producing from the embryonic stem cell a transgenic mouse whose somatic and germ cells contain the gene encoding the selectable marker.

A method for producing an antibody of interest, such as a human antibody, is disclosed in U.S. Pat. No. 5,916,771. It includes introducing an expression vector that contains a nucleotide sequence encoding a heavy chain into one mammalian host cell in culture, introducing an expression vector containing a nucleotide sequence encoding a light chain into another mammalian host cell, and fusing the two cells to form a hybrid cell. The hybrid cell expresses an antibody containing the heavy chain and the light chain. In a further improvement on this procedure, a method for identifying a clinically relevant epitope on an immunogen, and a correlative method for selecting an antibody that binds immunospecifically to the relevant epitope with high affinity, are disclosed in PCT publication WO 99/53049.

$F_{ab}$ Fragments and Single Chain Antibodies

According to the invention, techniques can be adapted for the production of single-chain antibodies specific to an antigenic protein of the invention (see e.g., U.S. Pat. No. 4,946,778). In addition, methods can be adapted for the construction of $F_{ab}$ expression libraries (see e.g., Huse, et al., 1989 Science 246: 1275–1281) to allow rapid and effective identification of monoclonal $F_{ab}$ fragments with the desired specificity for a protein or derivatives, fragments, analogs or homologs thereof. Antibody fragments that contain the idiotypes to a protein antigen may be produced by techniques known in the art including, but not limited to: (i) an $F_{(ab')2}$ fragment produced by pepsin digestion of an antibody molecule; (ii) an $F_{ab}$ fragment generated by reducing the disulfide bridges of an F(ab)$_2$ fragment; (iii) an $F_{ab}$ fragment generated by the treatment of the antibody molecule with papain and a reducing agent and (iv) F, fragments.

Bispecific Antibodies

Bispecific antibodies are monoclonal, preferably human or humanized, antibodies that have binding specificities for at least two different antigens. In the present case, one of the binding specificities is for an antigenic protein of the invention. The second binding target is any other antigen, and advantageously is a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities (Milstein and Cuello, Nature, 305:537–539 (1983)). Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published 13 May 1993, and in Traunecker et al., EMBO J. 10:3655–3659(1991).

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., Methods in Enzymology, L21:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared using chemical linkage. Brennan et al., Science 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Additionally, Fab' fragments can be directly recovered from E. coli and chemically coupled to form bispecific antibodies. Shalaby et al., J. Exp. Med. 175:217–225 (1992) describe the production of a fully humanized bispecific antibody F(ab')₂ molecule. Each Fab' fragment was separately secreted from E. coli and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., J. Immunol. 148(5):1547–1553 (1992). She leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., Proc. Natl. Acad. Sci. USA 90:6444–6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., J. Immunol. 152:5368 (1994).

Antibodies with more than two valencies are contemplated. For example, trispecific antibodies can be prepared. Tutt et al., J. Immunol. 147:60 (1991).

Exemplary bispecific antibodies can bind to two different epitopes, at least one of which originates in the protein antigen of the invention. Alternatively, an anti-antigenic arm of an immunoglobulin molecule can be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD 16) so as to focus cellular defense mechanisms to the cell expressing the particular antigen. Bispecific antibodies can also be used to direct cytotoxic agents to cells which express a particular antigen. These antibodies possess an antigen-binding arm and an arm which binds a cytotoxic agent or a radionuclide chelator, such as EOTUBE, DPTA, DOTA, or TETA. Another bispecific antibody of interest binds the protein antigen described herein and further binds tissue factor (TF).

Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells (U.S. Pat. No. 4,676,980), and for treatment of HIV infection (WO 91/00360; WO 92/200373; EP 03089). It is contemplated that the antibodies can be prepared in vitro using known methods in synthetic protein chemistry, including those involving crosslinking agents. For example, immunotoxins can be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

Effector Function Engineering

It can be desirable to modify the antibody of the invention with respect to effector function, so as to enhance, e.g., the effectiveness of the antibody in treating cancer. For example, cysteine residue(s) can be introduced into the Fc region, thereby allowing interchain disulfide bond formation in this region. The homodimeric antibody thus generated can have improved internalization capability and/or increased complement-mediated cell killing and antibody-dependent cellular cytotoxicity (ADCC). See Caron et al., J. Exp. Med., 176: 1191–1195 (1992) and Shopes, J. Immunol., 148: 2918–2922 (1992). Homodimeric antibodies with enhanced anti-tumor activity can also be prepared using heterobifunctional cross-linkers as described in Wolff et al. Cancer Research, 53: 2560–2565 (1993). Alternatively, an antibody can be engineered that has dual Fc regions and can thereby have enhanced complement lysis and ADCC capabilities. See Stevenson et al., Anti-Cancer Drug Design. 3: 219–230 (1989).

Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from Pseudomonas aeruginosa), ricin A chain, abrin A chain, modeccin A chain, alpha-sarcin, Aleurites fordii proteins, dianthin proteins, Phytolaca americana proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}Bi$, $^{131}I$, $^{131}In$, $^{90}Y$, and $^{186}Re$.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl)hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., Science, 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody can be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is in turn conjugated to a cytotoxic agent.

Immunoliposomes

The antibodies disclosed herein can also be formulated as immunoliposomes. Liposomes containing the antibody are prepared by methods known in the art, such as described in Epstein et al., *Proc. Natl. Acad. Sci. USA*, 82: 3688 (1985); Hwang et al., *Proc. Natl Acad. Sci. USA*, 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al., *J. Biol. Chem.*, 257: 286–288 (1982) via a disulfide-interchange reaction. A chemotherapeutic agent (such as Doxorubicin) is optionally contained within the liposome. See Gabizon et al., *J. National Cancer Inst.*, 81(19): 1484 (1989).

Diagnostic Applications of Antibodies Directed Against the Proteins of the Invention Antibodies directed against a protein of the invention may be used in methods known within the art relating to the localization and/or quantitation of the protein (e.g., for use in measuring levels of the protein within appropriate physiological samples, for use in diagnostic methods, for use in imaging the protein, and the like). In a given embodiment, antibodies against the proteins, or derivatives, fragments, analogs or homologs thereof, that contain the antigen binding domain, are utilized as pharmacologically-active compounds (see below).

An antibody specific for a protein of the invention can be used to isolate the protein by standard techniques, such as immunoaffinity chromatography or immunoprecipitation. Such an antibody can facilitate the purification of the natural protein antigen from cells and of recombinantly produced antigen expressed in host cells. Moreover, such an antibody can be used to detect the antigenic protein (e.g., in a cellular lysate or cell supernatant) in order to evaluate the abundance and pattern of expression of the antigenic protein. Antibodies directed against the protein can be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

Antibody Therapeutics

Antibodies of the invention, including polyclonal, monoclonal, humanized and fully human antibodies, may used as therapeutic agents. Such agents will generally be employed to treat or prevent a disease or pathology in a subject. An antibody preparation, preferably one having high specificity and high affinity for its target antigen, is administered to the subject and will generally have an effect due to its binding with the target. Such an effect may be one of two kinds, depending on the specific nature of the interaction between the given antibody molecule and the target antigen in question. In the first instance, administration of the antibody may abrogate or inhibit the binding of the target with an endogenous ligand to which it naturally binds. In this case, the antibody binds to the target and masks a binding site of the naturally occurring ligand, wherein the ligand serves as an effector molecule. Thus the receptor mediates a signal transduction pathway for which ligand is responsible.

Alternatively, the effect may be one in which the antibody elicits a physiological result by virtue of binding to an effector binding site on the target molecule. In this case the target, a receptor having an endogenous ligand which may be absent or defective in the disease or pathology, binds the antibody as a surrogate effector ligand, initiating a receptor-based signal transduction event by the receptor.

A therapeutically effective amount of an antibody of the invention relates generally to the amount needed to achieve a therapeutic objective. As noted above, this may be a binding interaction between the antibody and its target antigen that, in certain cases, interferes with the functioning of the target, and in other cases, promotes a physiological response. The amount required to be administered will furthermore depend on the binding affinity of the antibody for its specific antigen, and will also depend on the rate at which an administered antibody is depleted from the free volume other subject to which it is administered. Common ranges for therapeutically effective dosing of an antibody or antibody fragment of the invention may be, by way of nonlimiting example, from about 0.1 mg/kg body weight to about 50 mg/kg body weight. Common dosing frequencies may range, for example, from twice daily to once a week.

Pharmaceutical Compositions of Antibodies

Antibodies specifically binding a protein of the invention, as well as other molecules identified by the screening assays disclosed herein, can be administered for the treatment of various disorders in the form of pharmaceutical compositions. Principles and considerations involved in preparing such compositions, as well as guidance in the choice of components are provided, for example, in Remington: The Science And Practice Of Pharmacy 19th ed. (Alfonso R. Gennaro, et al., editors) Mack Pub. Co., Easton, Pa.: 1995; Drug Absorption Enhancement: Concepts, Possibilities, Limitations, And Trends, Harwood Academic Publishers, Langhorne, Pa., 1994; and Peptide And Protein Drug Delivery (Advances In Parenteral Sciences, Vol. 4), 1991, M. Dekker, New York.

If the antigenic protein is intracellular and whole antibodies are used as inhibitors, internalizing antibodies are preferred. However, liposomes can also be used to deliver the antibody, or an antibody fragment, into cells. Where antibody fragments are used, the smallest inhibitory fragment that specifically binds to the binding domain of the target protein is preferred. For example, based upon the variable-region sequences of an antibody, peptide molecules can be designed that retain the ability to bind the target protein sequence. Such peptides can be synthesized chemically and/or produced by recombinant DNA technology. See, e.g., Marasco et al., Proc. Natl. Acad. Sci. USA, 90: 7889–7893 (1993). The formulation herein can also contain more than one active compound as necessary for the particular indication being treated, preferably those with complementary activities that do not adversely affect each other. Alternatively, or in addition, the composition can comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients can also be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles, and nanocapsules) or in macroemulsions.

The formulations to be used for in vivo administration must be sterile. This is readily accomplished by filtration through sterile filtration membranes.

Sustained-release preparations can be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly (vinylalcohol)), polylactides (U.S. Pat. No. 3,773,919), copolymers of L-glutamic acid and γ methyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

ELISA Assay

An agent for detecting an analyte protein is an antibody capable of binding to an analyte protein, preferably an antibody with a detectable label. Antibodies can be polyclonal, or more preferably, monoclonal. An intact antibody, or a fragment thereof (e.g., $F_{ab}$ or $F_{(ab)2}$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. Included within the usage of the term "biological sample", therefore, is blood and a fraction or component of blood including blood serum, blood plasma, or lymph. That is, the detection method of the invention can be used to detect an analyte mRNA, protein, or genomic DNA in a biological sample in vitro as well as in vivo. For example, in vitro techniques for detection of an analyte mRNA include Northern hybridizations and in situ hybridizations. In vitro techniques for detection of an analyte protein include enzyme linked immunosorbent assays (ELISAs), Western blots, immunoprecipitations, and immunofluorescence. In vitro techniques for detection of an analyte genomic DNA include Southern hybridizations. Procedures for conducting immunoassays are described, for example in "ELISA: Theory and Practice: Methods in Molecular Biology", Vol. 42, J. R. Crowther (Ed.) Human Press, Totowa, N.J., 1995; "Immunoassay", E. Diamandis and T. Christopoulus, Academic Press, Inc., San Diego, Calif., 1996; and "Practice and Thory of Enzyme Immunoassays", P. Tijssen, Elsevier Science Publishers, Amsterdam, 1985. Furthermore, in vivo techniques for detection of an analyte protein include introducing into a subject a labeled anti-an analyte protein antibody. For example, the antibody can be labeled with a radioactive marker whose presence and location in a subject can be detected by standard imaging techniques.

NOVX Recombinant Expression Vectors and Host Cells

Another aspect of the invention pertains to vectors, preferably expression vectors, containing a nucleic acid encoding an NOVX protein, or derivatives, fragments, analogs or homologs thereof. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., nonepisomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, that is operatively-linked to the nucleic acid sequence to be expressed. Within a recombinant expression vector, "operably-linked" is intended to mean that the nucleotide sequence of interest is linked to the regulatory sequence(s) in a manner that allows for expression of the nucleotide sequence (e.g., in an in vitro transcription/translation system or in a host cell when the vector is introduced into the host cell). The term "regulatory sequence" is intended to includes promoters, enhancers and other expression control elements (e.g., polyadenylation signals). Such regulatory sequences are described, for example, in Goeddel, GENE EXPRESSION TECHNOLOGY: METHODS IN ENZYMOLOGY 185, Academic Press, San Diego, Calif. (1990). Regulatory sequences include those that direct constitutive expression of a nucleotide sequence in many types of host cell and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., NOVX proteins, mutant forms of NOVX proteins, fusion proteins, etc.).

The recombinant expression vectors of the invention can be designed for expression of NOVX proteins in prokaryotic or eukaryotic cells. For example, NOVX proteins can be expressed in bacterial cells such as *Escherichia coli*, insect cells (using baculovirus expression vectors) yeast cells or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988. *Gene* 67: 3140), pMAL (New England Biolabs, Beverly, Mass.) and pRITS (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (11988) *Gene* 69:301–315) and pET 11d (Studier et al., GENE EXPRESSION TECHNOLOGY: METHODS IN ENZYMOLOGY 185, Academic Press, San Diego, Calif. (1990) 60–89).

One strategy to maximize recombinant protein expression in *E. coli* is to express the protein in a host bacteria with an impaired capacity to proteolytically cleave the recombinant protein. See, e.g., Gottesman, GENE EXPRESSION TECHNOLOGY: METHODS IN ENZYMOLOGY 185, Academic Press, San Diego, Calif (1990) 119–128. Another strategy is to alter the nucleic acid sequence of the nucleic acid to be inserted into an expression vector so that the individual codons for each amino acid are those preferentially utilized in *E. coli* (see, e.g., Wada, et al., 1992. *Nucl. Acids Res.* 20: 2111–2118). Such alteration of nucleic acid sequences of the invention can be carried out by standard DNA synthesis techniques.

In another embodiment, the NOVX expression vector is a yeast expression vector. Examples of vectors for expression in yeast *Saccharomyces cerivisae* include pYepSec1 (Baldafi, et al., 1987. *EMBO J* 6: 229–234), pMFa (Kuijan and Herskowitz, 1982. *Cell* 30: 933–943), pJRY88 (Schultz et al., 1987. *Gene* 54: 113–123), pYES2 (Invitrogen Corporation, San Diego, Calif.), and picZ (InVitrogen Corp, San Diego, Calif.).

Alternatively, NOVX can be expressed in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156–2165) and the pVL series (Lucklow and Summers, 1989. *Virology* 170: 31–39).

In yet another embodiment, a nucleic acid of the invention is expressed in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187–195). When used in mammalian cells, the expression vector's control functions are often provided by viral regulatory elements. For example, commonly used promoters are derived from polyoma, adenovirus 2, cytomegalovirus, and simian virus 40. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268–277), lymphoid-specific promoters (Calame and Eaton, 1988. *Adv. Immunol.* 43: 235–275), in particular promoters of T cell receptors (Winoto and Baltimore, 1989. *EMBO J.* 8: 729–733) and immunoglobulins (Baneri, et al., 1983. *Cell* 33: 729–740; Queen and Baltimore, 1983. *Cell* 33: 741–748), neuron-specific promoters (e.g., the neurofilament promoter; Byme and Ruddle, 1989. *Proc. Natl. Acad. Sci. USA* 86: 5473–5477), pancreas-specific promoters (Edlund, et al., 1985. *Science* 230: 912–916), and mammary gland-specific promoters (e.g., milk whey promoter, U.S. Pat. No. 4,873, 316 and European Application Publication No. 264,166). Developmentally-regulated promoters are also encompassed, e.g., the murine box promoters (Kessel and Gruss, 1990. *Science* 249: 374–379) and the α-fetoprotein promoter (Campes and Tilghman, 1989. *Genes Dev.* 3: 537–546).

The invention further provides a recombinant expression vector comprising a DNA molecule of the invention cloned into the expression vector in an antisense orientation. That is, the DNA molecule is operatively-linked to a regulatory sequence in a manner that allows for expression (by transcription of the DNA molecule) of an RNA molecule that is antisense to NOVX mRNA. Regulatory sequences operatively linked to a nucleic acid cloned in the antisense orientation can be chosen that direct the continuous expression of the antisense RNA molecule in a variety of cell types, for instance viral promoters and/or enhancers, or regulatory sequences can be chosen that direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see, e.g., Weintraub, et at., "Antisense RNA as a molecular tool for genetic analysis," *Reviews-Trends in Genetics*, Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, NOVX protein can be expressed in bacterial cells such as *E. coli*, insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (MOLECULAR CLONING: A LABORATORY MANUAL. 2nd ed., Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Various selectable markers include those that confer resistance to drugs, such as G418, hygromycin and methotrexate. Nucleic acid encoding a selectable marker can be introduced into a host cell on the same vector as that encoding NOVX or can be introduced on a separate vector. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) NOVX protein. Accordingly, the invention further provides methods for producing NOVX protein using the host cells of the invention. In one embodiment, the method comprises culturing the host cell of invention (into which a recombinant expression vector encoding NOVX protein has been introduced) in a suitable medium such that NOVX protein is produced. In another embodiment, the method further comprises isolating NOVX protein from the medium or the host cell.

Transgenic NOVX Animals

The host cells of the invention can also be used to produce non-human transgenic animals. For example, in one embodiment, a host cell of the invention is a fertilized oocyte or an embryonic stem cell into which NOVX protein-coding sequences have been introduced. Such host cells can then be used to create non-human transgenic animals in which exogenous NOVX sequences have been introduced into their genome or homologous recombinant animals in which endogenous NOVX sequences have been altered. Such animals are useful for studying the function and/or activity of NOVX protein and for identifying and/or evaluating modulators of NOVX protein activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA that is integrated into the genome of a cell from which a tratisgenic animal develops and that remains in the genome of the mature animal, thereby directing the expression of an encoded gene product in one or more cell types or tissues of the transgenic animal. As used herein, a "homologous recombinant animal" is a non-human animal, preferably a mammal, more preferably a mouse, in which an endogenous NOVX gene has been altered by homologous recombination between the endogenous gene and an exogenous DNA molecule introduced into a cell of the animal, e.g., an embryonic cell of the animal, prior to development of the animal.

A transgenic animal of the invention can be created by introducing NOVX-encoding nucleic acid into the male pronuclei of a fertilized oocyte (e.g., by microinjection, retroviral infection) and allowing the oocyte to develop in a pseudopregnant female foster animal. The human NOVX cDNA sequences SEQ ID NOS:1, 3, 5, 7, 9, 11, 13, 15, 17, 19, 21, 23, 25, 27, 29, 31, 33, 35, 37, 39, 41, 43, 45, and 197 can be introduced as a transgene into the genome of a non-human animal. Alternatively, a non-human homologue of the human NOVX gene, such as a mouse NOVX gene, can be isolated based on hybridization to the human NOVX cDNA (described further supra) and used as a transgene. Intronic sequences and polyadenylation signals can also be included in the transgene to increase the efficiency of expression of the transgene. A tissue-specific regulatory sequence(s) can be operably-linked to the NOVX transgene to direct expression of NOVX protein to particular cells. Methods for generating transgenic animals via embryo manipulation and microinjection, particularly animals such as mice, have become conventional in the art and are described, for example, in U.S. Pat. Nos. 4,736,866; 4,870,009; and 4,873,191; and Hogan, 1986. In: MANIPULATING THE MOUSE EMBRYO, Cold Spring Harbor Laboratory Press, Cold Spring Harbor, N.Y. Similar methods are used for production of other transgenic animals. A transgenic founder animal can be identified based upon the presence of the NOVX transgene in its genome and/or expression of NOVX mRNA in tissues or cells of the animals. A transgenic founder animal can then be used to breed additional animals carrying the transgene. Moreover, transgenic animals carrying a transgene-encoding NOVX protein can further be bred to other transgenic animals carrying other transgenes.

To create a homologous recombinant animal, a vector is prepared which contains at least a portion of an NOVX gene into which a deletion, addition or substitution has been introduced to thereby alter, e.g., functionally disrupt, the NOVX gene. The NOVX gene can be a human gene (e.g., the cDNA of SEQ ID NOS:1, 3, 5, 7, 9, 11, 13, 15, 17, 19, 21, 23, 25, 27, 29, 31, 33, 35, 37, 39, 41, 43, 45, and 197), but more preferably, is a non-human homologue of a human NOVX gene. For example, a mouse homologue of human NOVX gene of SEQ ID NOS:1, 3, 5, 7, 9, 11, 13, 15, 17, 19, 21, 23, 25, 27, 29, 31, 33, 35, 37, 39, 41, 43, 45, and 197 can be used to construct a homologous recombination vector suitable for altering an endogenous NOVX gene in the mouse genome. In one embodiment, the vector is designed such that, upon homologous recombination, the endogenous NOVX gene is functionally disrupted (i.e., no longer encodes a functional protein; also referred to as a "knock out" vector).

Alternatively, the vector can be designed such that, upon homologous recombination, the endogenous NOVX gene is mutated or otherwise altered but still encodes functional protein (e.g., the upstream regulatory region can be altered to thereby alter the expression of the endogenous NOVX protein). In the homologous recombination vector, the altered portion of the NOVX gene is flanked at its 5'- and 3'-termini by additional nucleic acid of the NOVX gene to allow for homologous recombination to occur between the exogenous NOVX gene carried by the vector and an endogenous NOVX gene in an embryonic stem cell. The additional flanking NOVX nucleic acid is of sufficient length for successful homologous recombination with the endogenous gene. Typically, several kilobases of flanking DNA (both at the 5'- and 3'-termini) are included in the vector. See, e.g., Thomas, et al., 1987. *Cell* 51: 503 for a description of homologous recombination vectors. The vector is ten introduced into an embryonic stem cell line (e.g., by electroporation) and cells in which the introduced NOVX gene has homologously-recombined with the endogenous NOVX gene are selected. See, e.g., Li, et al., 1992. *Cell* 69: 915.

The selected cells are then injected into a blastocyst of an animal (e.g., a mouse) to form aggregation chimeras. See, e.g., Bradley, 1987. In: TERATOCARCINOMAS AND EMBRYONIC STEM CELLS: A PRACTICAL APPROACH, Robertson, ed. IRL, Oxford, pp. 113–152. A chimeric embryo can then be implanted into a suitable pseudopregnant female foster animal and the embryo brought to term. Progeny harboring the homologously-recombined DNA in their germ cells can be used to breed animals in which all cells of the animal contain the homologously-recombined DNA by germline transmission of the transgene. Methods for constructing homologous recombination vectors and homologous recombinant animals are described further in Bradley, 1991. *Curr. Opin. Biotechnol.* 2: 823–829; PCT International Publication Nos.: WO 90/11354; WO 91/01140; WO 92/0968; and WO 93/04169.

In another embodiment, transgenic non-humans animals can be produced that contain selected systems that allow for regulated expression of the transgene. One example of such a system is the cre/loxP recombinase system of bacteriophage P1. For a description of the cre/loxP recombinase system, See, e.g., Uakso, et al., 1992. Proc. Natl. Acad. Sci. USA 89: 6232–6236. Another example of a recombinase system is the FLP recombinase system of *Saccharomyces cerevisiae*. See, O'Gorman, et al., 1991. Science 251:1351–1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, et al., 1997. *Nature* 385: 810–813. In brief, a cell (e.g., a somatic cell) from the transgenic animal can be isolated and induced to exit the growth cycle and enter $G_0$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyte and then transferred to pseudopregnant female foster animal. The offspring borne of this female foster animal will be a clone of the animal from which the cell (e.g., the somatic cell) is isolated.

Pharmaceutical Compositions

The NOVX nucleic acid molecules, NOVX proteins, and anti-NOVX antibodies (also referred to herein as "active compounds") of the invention, and derivatives, fragments, analogs and homologs thereof, can be incorporated into pharmaceutical compositions suitable for administration. Such compositions typically comprise the nucleic acid molecule, protein, or antibody and a pharmaceutically acceptable carrier. As used herein, "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Preferred examples of such carriers or diluents include, but are not limited to, water, saline, finger's solutions, dextrose solution, and 5% human serum albumin. Liposomes and non-aqueous vehicles such as fixed oils may also be used. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the invention is formulated to be compatible with its intended route of administration. Examples of routes of administration include parenteral, e.g., intravenous, intradermal, subcutaneous, oral (e.g., inhalation), transdermal (i.e., topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass Or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., an NOVX protein or anti-NOVX antibody) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or cornstarch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

The nucleic acid molecules of the invention can be inserted into vectors and used as gene therapy vectors. Gene therapy vectors can be delivered to a subject by, for example, intravenous injection, local administration (see, e.g., U.S. Pat. No. 5,328,470) or by stereotactic injection (see, e.g., Chen, et al., 1994. *Proc. Natl. Acad. Sci. USA* 91: 3054–3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells that produce the gene delivery system. The pharmaceutical compositions can be included in a container, pack, or dispenser together with instructions for administration.

Screening and Detection Methods

The isolated nucleic acid molecules of the invention can be used to express NOVX protein (e.g., via a recombinant expression vector in a host cell in gene therapy applications), to detect NOVX mRNA (e.g., in a biological sample) or a genetic lesion in an NOVX gene, and to modulate NOVX activity, as described further, below. In addition, the NOVX proteins can be used to screen drugs or compounds that modulate the NOVX protein activity or expression as well as to treat disorders characterized by insufficient or excessive production of NOVX protein or production of NOVX protein forms that have decreased or aberrant activity compared to NOVX wild-type protein (e.g.; diabetes (regulates insulin release); obesity rinds and transport lipids); metabolic disturbances associated with obesity, the metabolic syndrome X as well as anorexia and wasting disorders associated with chronic diseases and various cancers, and infectious disease possesses anti-microbial activity) and the various dyslipidemias. In addition, the anti-NOX antibodies of the invention can be used to detect and isolate NOVX proteins and modulate NOVX activity. In yet a further aspect, the invention can be used in methods to influence appetite, absorption of nutrients and the disposition of metabolic substrates in both a positive and negative fashion.

The invention further pertains to novel agents identified by the screening assays described herein and uses thereof for treatments as described, supra.

Screening Assays

The invention provides a method (also referred to herein as a "screening assay") for identifying modulators, i.e., candidate or test compounds or agents (e.g., peptides, peptidomimetics, small molecules or other drugs) that bind to NOVX proteins or have a stimulatory or inhibitory effect on, e.g., NOVX protein expression or NOVX protein activity.

The invention also includes compounds identified in the screening assays described herein.

In one embodiment the invention provides assays for screening candidate or test compounds which bind to or modulate the activity of the membrane-bound form of an NOVX protein or polypeptide or biologically-active portion thereof. The test compounds of the invention can be obtained using any of the numerous approaches in combinatorial library methods known in the art, including: biological libraries; spatially addressable parallel solid phase or solution phase libraries; synthetic library methods requiring deconvolution; the "one-bead one-compound" library method; and synthetic library methods using affinity chromatography selection. The biological library approach is limited to peptide libraries, while the other four approaches are applicable to peptide, non-peptide oligomer or small molecule libraries of compounds. See, e.g., Lam, 1997. *Anticancer Drug Design* 12: 145.

A "small molecule" as used herein, is meant to refer to a composition that has a molecular weight of less than about 5 kD and most preferably less than about 4 kD. Small molecules can be, e.g., nucleic acids, peptides, polypeptides, peptidomimetics, carbohydrates, lipids or other organic or inorganic molecules. Libraries of chemical and/or biological mixtures, such as fungal, bacterial, or algal extracts, are known in the art and can be screened with any of the assays of the invention.

Examples of methods for the synthesis of molecular libraries can be found in the art, for example in: DeWitt, et al., 1993. *Proc. Natl. Acad. Sci. U.S.* 90: 6909; Erb, et al., 1994. *Proc. Natl. Acad. Sci. U.S.A.* 91: 11422; Zuckermann, et al., 1994. *J. Med. Chem.* 37: 2678; Cho, et al., 1993. *Science* 261: 1303; Carrell, et al., 1994. *Angew. Chem. Int. Ed. Engl.* 33: 2059; Carell, et al., 1994. *Angew. Chem. Int. Ed. Engl.* 33:2061; and Gallop, et al., 1994. *J. Med. Chem.* 37: 1233.

Libraries of compounds may be presented in solution (e.g., Houghten, 1992. *Biotechniques* 13: 412421), or on beads (Lam, 1991. *Nature* 354: 82–84), on chips (Fodor, 1993. *Nature* 364: 555–556), bacteria (Ladner, U.S. Pat. No. 5,223,409), spores (Ladner, U.S. Pat. No. 5,233,409), plasmids (Cull, et al., 1992. *Proc. Natl. Acad. Sci. USA* 89: 1865–1869) or on phage (Scott and Smith, 1990. *Science* 249: 386–390; Devlin, 1990. *Science* 249: 404406; Cwirla, et al., 1990. *Proc. Natl. Acad. Sci. U.S.* 87: 6378–6382; Felici, 1991. *J. Mol. Biol.* 222: 301–310; Ladner, U.S. Pat. No. 5,233,409.).

In one embodiment, an assay is a cell-based assay in which a cell which expresses a membrane-bound form of NOVX protein, or a biologically-active portion thereof, on the cell surface is contacted with a test compound and the ability of the test compound to bind to an NOVX protein determined. The cell, for example, can of mammalian origin or a yeast cell. Determining the ability of the test compound to bind to the NOVX protein can be accomplished, for example, by coupling the test compound with a radioisotope or enzymatic label such that binding of the test compound to the NOVX protein or biologically-active portion thereof can be determined by detecting the labeled compound in a complex. For example, test compounds can be labeled with $^{125}I$, $^{35}S$, $^{14}C$, or $^{3}H$, either directly or indirectly, and the radioisotope detected by direct counting of radioemission or by scintillation counting. Alternatively, test compounds can be enzymatically-labeled with, for example, horseradish peroxidase, alkaline phosphatase, or luciferase, and the enzymatic label detected by determination of conversion of an appropriate substrate to product. In one embodiment, the assay comprises contacting a cell which expresses a membrane-bound form of NOVX protein, or a biologically-active portion thereof, on the cell surface with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX protein or a biologically-active portion thereof as compared to the known compound.

In another embodiment, an assay is a cell-based assay comprising contacting a cell expressing a membrane-bound form of NOVX protein, or a biologically-active portion thereof, on the cell surface with a test compound and determining the ability of the test compound to modulate (e.g., stimulate or inhibit) the activity of the NOVX protein or biologically-active portion thereof. Determining the ability of the test compound to modulate the activity of NOVX or a biologically-active portion thereof can be accomplished, for example, by determining the ability of the NOVX protein to bind to or interact with an NOVX target molecule. As used herein, a "target molecule" is a molecule with which an NOVX protein binds or interacts in nature, for example, a molecule on the surface of a cell which expresses an NOVX interacting protein, a molecule on the surface of a second cell, a molecule in the extracellular milieu, a molecule associated with the internal surface of a cell membrane or a cytoplasmic molecule. An NOVX target molecule can be a non-NOVX molecule or an NOVX protein or polypeptide of the invention. In one embodiment, an NOVX target molecule is a component of a signal transduction pathway that facilitates transduction of an extracellular signal (e.g. a signal generated by binding of a compound to a membrane-bound NOVX molecule) through the cell membrane and into the cell. The target, for example, can be a second intercellular protein that has catalytic activity or a protein that facilitates the association of downstream signaling molecules with NOVX.

Determining the ability of the NOVX protein to bind to or interact with an NOVX target molecule can be accomplished by one of the methods described above for determining L direct binding. In one embodiment, determining the ability of the NOVX protein to bind to or interact with an NOVX target molecule can be accomplished by determining the activity of the target molecule. For example, the activity of the target molecule can be determined by detecting induction of a cellular second messenger of the target (i.e. intracellular $Ca^{2+}$, diacylglycerol, $IP_3$, etc.), detecting catalytic/enzymatic activity of the target an appropriate substrate, detecting the induction of a reporter gene (comprising an NOVX-responsive regulatory element operatively linked to a nucleic acid encoding a detectable marker, e.g., luciferase), or detecting a cellular response, for example, cell survival, cellular differentiation, or cell proliferation.

In yet another embodiment, an assay of the invention is a cell-free assay comprising contacting an NOVX protein or biologically-active portion thereof with a test compound and determining the ability of the test compound to bind to the NOVX protein or biologically-active portion thereof. Binding of the test compound to the NOVX protein can be determined either directly or indirectly as described above. In one such embodiment, the assay comprises contacting the NOVX protein or biologically-active portion thereof with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX or biologically-active portion thereof as compared to the known compound.

In still another embodiment, an assay is a cell-free assay comprising contacting NOVX protein or biologically-active portion thereof with a test compound and determining the ability of the test compound to modulate (e.g. stimulate or inhibit) the activity of the NOVX protein or biologically-active portion thereof. Determining the ability of the test compound to modulate the activity of NOVX can be accomplished, for example, by determining the ability of the NOVX protein to bind to an NOVX target molecule by one of the methods described above for determining direct binding. In an alternative embodiment, determining the ability of the test compound to modulate the activity of NOVX protein can be accomplished by determining the ability of the NOVX protein further modulate an NOVX target molecule. For example, the catalytic/enzymatic activity of the target molecule on an appropriate substrate can be determined as described, supra.

In yet another embodiment, the cell-free assay comprises contacting the NOVX protein or biologically-active portion thereof with a known compound which binds NOVX protein to form an assay mixture, contacting the assay mixture with a test compound, and determining the ability of the test compound to interact with an NOVX protein, wherein determining the ability of the test compound to interact with an NOVX protein comprises determining the ability of the NOVX protein to preferentially bind to or modulate the activity of an NOVX target molecule.

The cell-free assays of the invention are amenable to use of both the soluble form or the membrane-bound form of NOVX protein. In the case of cell-free assays comprising the membrane-bound form of NOVX protein, it may be desirable to utilize a solubilizing agent such that the membrane-bound form of NOVX protein is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, N-dodecyl-N,N-dimethyl-3-ammonio-1-propane sulfonate, 3-(3-cholamidopropyl)dimethylamminiol-1-propane sulfonate (CHAPS), or 3-(3-cholamidopropyl) dimethylamminiol-2-hydroxy-1-propane sulfonate (CHAPSO).

In more than one embodiment of the above assay methods of the invention, it may be desirable to immobilize either NOVX protein or its target molecule to facilitate separation of complexed from uncomplexed forms of one or both of the proteins, as well as to accommodate automation of the assay. Binding of a test compound to NOVX protein, or interaction of NOVX protein with a target molecule in the presence and absence of a candidate compound, can be accomplished in any vessel suitable for containing the reactants. Examples of such vessels include microtiter plates, test tubes, and microcentrifuge tubes. In one embodiment, a fusion protein can be provided that adds a domain that allows one or both of the proteins to be bound to a matrix. For example, GST-NOVX fusion proteins or GST-target fusion proteins can be adsorbed onto glutathione sepharose beads (Sigma Chemical, St. Louis, Mo.) or glutathione derivatized microtiter plates, that are then combined with the test compound or the test compound and either the non-adsorbed target protein or NOVX protein, and the mixture is incubated under conditions conducive to complex formation (e.g., at physiological conditions for salt and pH). Following incubation, the beads or microtiter plate wells are washed to remove any unbound components, the matrix immobilized in the case of beads, complex determined either directly or indirectly, for example, as described, supra. Alternatively, the complexes can be dissociated from the matrix, and the level of NOVX protein binding or activity determined using standard techniques.

Other techniques for immobilizing proteins on matrices can also be used in the screening assays of the invention. For example, either the NOVX protein or its target molecule can be immobilized utilizing conjugation of biotin and streptavidin. Biotinylated NOVX protein or target molecules can be prepared from biotin-NHS (N-hydroxy-succinimide) using techniques well-known within the art (e.g., biotinylation kit, Pierce Chemicals, Rockford, Ill.), and immobilized in the wells of streptavidin-coated 96 well plates (Pierce Chemical). Alternatively, antibodies reactive with NOVX protein or target molecules, but which do not interfere with binding of the NOVX protein to its target molecule, can be derivatized to the wells of the plate, and unbound target or NOVX protein trapped in the wells by antibody conjugation. Methods for detecting such complexes, in addition to those described above for the GST-immobilized complexes, include immunodetection of complexes using antibodies reactive with the NOVX protein or target molecule, as well as enzyme-linked assays that rely on detecting an enzymatic activity associated with the NOVX protein or target molecule.

In another embodiment, modulators of NOVX protein expression are identified in a method wherein a cell is contacted with a candidate compound and the expression of NOVX mRNA or protein in the cell is determined. The level of expression of NOVX mRNA or protein in the presence of the candidate compound is compared to the level of expression of NOVX mRNA or protein in the absence of the candidate compound. The candidate compound can then be identified as a modulator of NOVX mRNA or protein expression based upon this comparison. For example, when expression of NOVX mRNA or protein is greater (i.e., statistically significantly greater) in the presence of the candidate compound than in its absence, the candidate compound is identified as a stimulator of NOVX mRNA or protein expression. Alternatively, when expression of NOVX mRNA or protein is less (statistically significantly less) in the presence of the candidate compound than in its absence, the candidate compound is identified as an inhibitor of NOVX mRNA or protein expression. The level of NOVX mRNA or protein expression in the cells can be determined by methods described herein for detecting NOVX mRNA or protein.

In yet another aspect of the invention, the NOVX proteins can be used as "bait proteins" in a two-hybrid assay or three hybrid assay (see, e.g., U.S. Pat. No. 5,283,317; Zervos, et al., 1993. *Cell* 72: 223–232; Madura, et al., 1993. *J. Biol. Chem.* 268: 12046–12054; Bartel, et al., 1993. *Biotechniques* 14: 920–924; Iwabuchi, et al., 1993. *Oncogene* 8: 1693–1696; and Brent WO 94/10300), to identify other proteins that bind to or interact with NOVX ("NOVX-binding proteins" or "NOVX-bp") and modulate NOVX activity. Such NOVX-binding proteins are also likely to be involved in the propagation of signals by the NOVX proteins as, for example, upstream or downstream elements of the NOVX pathway.

The two-hybrid system is based on the modular nature of most transcription factors, which consist of separable DNA-binding and activation domains. Briefly, the assay utilizes two different DNA constructs. In one construct, the gene that codes for NOVX is fused to a gene encoding the DNA binding domain of a known transcription factor (e.g., GAL4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming an NOVX-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected and cell colonies containing the functional transcription factor can be isolated and used to obtain the cloned gene that encodes the protein which interacts with NOVX.

The invention further pertains to novel agents identified by the aforementioned screening assays and uses thereof for treatments as described herein.

Detection Assays

Portions or fragments of the cDNA sequences identified herein (and the corresponding complete gene sequences) can be used in numerous ways as polynucleotide reagents. By way of example, and not of limitation, these sequences can be used to: (i) map their respective genes on a chromosome; and, thus, locate gene regions associated with genetic disease; (ii) identify an individual from a minute biological sample (tissue typing); and (iii) aid in forensic identification of a biological sample. Some of these applications are described in the subsections, below.

Chromosome Mapping

Once the sequence (or a portion of the sequence) of a gene has been isolated, this sequence can be used to map the location of the gene on a chromosome. This process is called chromosome mapping. Accordingly, portions or fragments of the NOVX sequences, SEQ ID NOS:1, 3, 5, 7, 9, 11, 13, 15, 17, 19, 21, 23, 25, 27, 29, 31, 33, 35, 37, 39, 41, 43, 45, and 197, or fragments or derivatives thereof, can be used to map the location of the NOVX genes, respectively, on a chromosome. The mapping of the NOVX sequences to chromosomes is an important first step in correlating these sequences with genes associated with disease.

Briefly, NOVX genes can be mapped to chromosomes by preparing PCR primers (preferably 15–25 bp in length) from the NOVX sequences. Computer analysis of the NOVX, sequences can be used to rapidly select primers that do not span more than one exon in the genomic DNA, thus complicating the amplification process. These primers can then be used for PCR screening of somatic cell hybrids containing individual human chromosomes. Only those hybrids containing the human gene corresponding to the NOVX sequences will yield an amplified fragment.

Somatic cell hybrids are prepared by fusing somatic cells from different mammals (e.g., human and mouse cells). As hybrids of human and mouse cells grow and divide, they gradually lose human chromosomes in random order, but retain the mouse chromosomes. By using media in which mouse cells cannot grow, because they lack a particular enzyme, but in which human cells can, the one human chromosome that contains the gene encoding the needed enzyme will be retained. By using various media, panels of hybrid cell lines can be established. Each cell line in a panel contains either a single human chromosome or a small number of human chromosomes, and a full set of mouse chromosomes, allowing easy mapping of individual genes to specific human chromosomes. See, e.g., D'Eustachio, et al., 1983. *Science* 220: 919–924. Somatic cell hybrids containing only fragments of human chromosomes can also be produced by using human chromosomes with translocations and deletions.

PCR mapping of somatic cell hybrids is a rapid procedure for assigning a particular sequence to a particular chromosome. Three or more sequences can be assigned per day using a single thermal cycler. Using the NOVX sequences to design oligonucleotide primers, sub-localization can be achieved with panels of fragments from specific chromosomes.

Fluorescence in situ hybridization (FISH) of a DNA sequence to a metaphase chromosomal spread can further be used to provide a precise chromosomal location in one step. Chromosome spreads can be made using cells whose division has been blocked in metaphase by a chemical like colcemid that disrupts the mitotic spindle. The chromosomes can be treated briefly with trypsin, and then stained with Giemsa. A pattern of light and dark bands develops on each chromosome, so that the chromosomes can be identified individually. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases, will suffice to get good results at a reasonable amount of time. For a review of this technique, see, Verma, et al., HUMAN CHROMOSOMES: A MANUAL OF BASIC TECHNIQUES (Pergamon Press, New York 1988).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping. Once a sequence has been mapped to a precise chromosomal location, the physical position of the sequence on the chromosome can be correlated with genetic map data. Such data are found, e.g. in McKusick, MENDELIAN INHERITANCE IN MAN, available on-line through Johns Hopkins University Welch Medical Library). The relationship between genes and disease, mapped to the same chromosomal region, can then be identified through linkage analysis (co-inheritance of physically adjacent genes), described in, e.g. Egeland, et al., 1987. *Nature,* 325: 783–787.

Moreover, differences in the DNA sequences between individuals affected and unaffected with a disease associated with the NOVX gene, can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes, such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

Tissue Typing

The NOVX sequences of the invention can also be used to identify individuals from minute biological samples. In this technique, an individual's genomic DNA is digested with one or more restriction enzymes, and probed on a Southern blot to yield unique bands for identification. The sequences of the invention are useful as additional DNA markers for RFLP if ("restriction fragment length polymorphisms," described in U.S. Pat. No. 5,272,057).

Furthermore, the sequences of the invention can be used to provide an alternative technique that determines the actual base-by-base DNA sequence of selected portions of an individual's genome. Thus, the NOVX sequences described herein can be used to prepare two PCR primers from the 5'- and 3'-termini of the sequences. These primers can then be used to amplify an individual's DNA and subsequently sequence it.

Panels of corresponding DNA sequences from individuals, prepared in this manner, can provide unique individual identifications, as each individual will have a unique set of such DNA sequences due to allelic differences. The sequences of the invention can be used to obtain such identification sequences from individuals and from tissue. The NOVX sequences of the invention uniquely represent portions of the human genome. Allelic variation occurs to some degree in the coding regions of these sequences, and to a greater degree in the noncoding regions. It is estimated that allelic variation between individual humans occurs with a frequency of about once per each 500 bases. Much of the allelic variation is due to single nucleotide polymorphisms (SNPs), which include restriction fragment length polymorphisms (RFLPs).

Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences can comfortably provide positive individual identification with a panel of perhaps 10 to 1,000 primers that each yield a noncoding amplified sequence of 100 bases. If predicted coding sequences, such as those in SEQ ID NOS:1, 3, 5, 7, 9, 11, 13, 15, 17, 19, 21, 23, 25, 27, 29, 31, 33, 35, 37, 39, 41, 43, 45, and 197 are used, a more appropriate number of primers for positive individual identification would be 500–2,000.

Predictive Medicine

The invention also pertains to the field of predictive medicine in which diagnostic assays, prognostic assays, pharmacogenomics, and monitoring clinical trials are used for prognostic (predictive) purposes to thereby treat an individual prophylactically. Accordingly, one aspect of the invention relates to diagnostic assays for determining NOVX protein and/or nucleic acid expression as well as NOVX activity, in the context of a biological sample (e.g., blood, serum, cells, tissue) to thereby determine whether an individual is afflicted with a disease or disorder, or is at risk of developing a disorder, associated with aberrant NOVX expression or activity. The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers. The invention also provides for prognostic (or predictive) assays for determining whether an individual is at risk of developing a disorder associated with NOVX protein nucleic acid expression or activity. For example, mutations in an NOVX gene can be assayed in a biological sample. Such assays can be used for prognostic or predictive purpose to thereby prophylactically treat an individual prior to the onset of a disorder characterized by or associated with NOVX protein, nucleic acid expression, or biological activity.

Another aspect of the invention provides methods for determining NOVX protein, nucleic acid expression or activity in an individual to thereby select appropriate therapeutic or prophylactic agents for that individual (referred to herein as "pharmacogenomics"). Pharmacogenomics allows for the selection of agents (e.g., drugs) for therapeutic or prophylactic treatment of an individual based on the genotype of the individual (e.g., the genotype of the individual examined to determine the ability of the individual to respond to a particular agent.)

Yet another aspect of the invention pertains to monitoring the influence of agents (e.g., drugs, compounds) on the expression or activity of NOVX in clinical trials.

These and other agents are described in further detail in the following sections.

Diagnostic Assays

An exemplary method for detecting the presence or absence of NOVX in a biological sample involves obtaining a biological sample from a test subject and contacting the biological sample with a compound or an agent capable of detecting NOVX protein or nucleic acid (e.g., mRNA, genomic DNA) that encodes NOVX protein such that the presence of NOVX is detected in the biological sample. An agent for detecting NOVX mRNA or genomic DNA is a labeled nucleic acid probe capable of hybridizing to NOVX mRNA or genomic DNA. The nucleic acid probe can be, for example, a full-length NOVX nucleic acid, such as the nucleic acid of SEQ ID NOS:1, 3, 5, 7, 9, 11, 13, 15, 17, 19, 21, 23, 25, 27, 29, 31, 33, 35, 37, 39, 41, 43, 45, and 197, or a portion thereof, such as an oligonucleotide of at least 15, 30, 50, 100, 250 or 500 nucleotides in length and sufficient to specifically hybridize under stringent conditions to NOVX mRNA or genomic DNA. Other suitable probes for use in the diagnostic assays of the invention are described herein.

An agent for detecting NOVX protein is an antibody capable of binding to NOVX protein, preferably an antibody with a detectable label. Antibodies can be polyclonal, or more preferably, monoclonal. An intact antibody, or a fragment thereof (e.g., $F_{ab}$ or $F(ab')_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. That is, the detection method of the invention can be used to detect NOVX mRNA, protein, or genomic DNA in a biological sample in vitro as well as in vivo. For example, in vitro techniques for detection of NOVX mRNA include Northern hybridizations and in situ hybridizations. In vitro techniques for detection of NOVX protein include enzyme linked immunosorbent assays (ELISAs), Western blots, immunoprecipitations, and immunofluorescence. In vitro techniques for detection of NOVX genomic DNA include Southern hybridizations. Furthermore, in vivo techniques for detection of NOVX protein include introducing into a subject a labeled anti-NOVX antibody. For example, the antibody can be labeled with a radioactive marker whose presence and location in a subject can be detected by standard imaging techniques.

In one embodiment, the biological sample contains protein molecules from the test subject. Alternatively, the biological sample can contain mRNA molecules from the test subject or genomic DNA molecules from the test subject. A preferred biological sample is a peripheral blood leukocyte sample isolated by conventional means from a subject.

In another embodiment, the methods further involve obtaining a control biological sample from a control subject, contacting the control sample with a compound or agent capable of detecting NOVX protein, mRNA, or genomic DNA, such that the presence of NOVX protein, mRNA or genomic DNA is detected in the biological sample, and comparing the presence of NOVX protein, mRNA or genomic DNA in the control sample with the presence of NOVX protein, mRNA or genomic DNA in the test sample.

The invention also encompasses kits for detecting the presence of NOVX in a biological sample. For example, the kit can comprise: a labeled compound or agent capable of detecting NOVX protein or mRNA in a biological sample; means for determining the amount of NOVX in the sample; and means for comparing the amount of NOVX in the sample with a standard. The compound or agent can be packaged in a suitable container. The kit can further comprise instructions for using the kit to detect NOVX protein or nucleic acid.

Prognostic Assays

The diagnostic methods described herein can furthermore be utilized to identify subjects having or at risk of developing a disease or disorder associated with aberrant NOVX expression or activity. For example, the assays described herein, such as the preceding diagnostic assays or the following assays, can be utilized to identify a subject having or at risk of developing a disorder associated with NOVX protein, nucleic acid expression or activity. Alternatively, the prognostic assays can be utilized to identify a subject having or at risk for developing a disease or disorder. Thus, the invention provides a method for identifying a disease or disorder associated with aberrant NOVX expression or activity in which a test sample is obtained from a subject and NOVX protein or nucleic acid (e.g., mRNA, genomic DNA) is detected, wherein the presence of NOVX protein or nucleic acid is diagnostic for a subject having or at risk of developing a disease or disorder associated with aberrant NOVX expression or activity. As used herein, a "test sample" refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant NOVX expression or activity. For example, such methods can be used to determine whether a subject can be effectively treated with an agent for a disorder.

Thus, the invention provides methods for determining whether a subject can be effectively treated with an agent for a disorder associated with aberrant NOVX expression or activity in which a test sample is obtained and NOVX protein or nucleic acid is detected (e.g., wherein the presence of NOVX protein or nucleic acid is diagnostic for a subject that can be administered the agent to treat a disorder associated with aberrant NOVX expression or activity).

The methods of the invention can also be used to detect genetic lesions in an NOVX gene, thereby determining if a subject with the lesioned gene is at risk for a disorder characterized by aberrant cell proliferation and/or differentiation. In various embodiments, the methods include detecting, in a sample of cells from the subject, the presence or absence of a genetic lesion characterized by at least one of an alteration affecting the integrity of a gene encoding an NOVX-protein, or the misexpression of the NOVX gene. For example, such genetic lesions can be detected by ascertaining the existence of at least one of: (i) a deletion of one or more nucleotides from an NOVX gene; (ii) an addition of one or more nucleotides to an NOVX gene; (iii) a substitution of one or more nucleotides of an NOVX gene, (iv) a chromosomal rearrangement of an NOVX gene; (v) an alteration in the level of a messenger RNA transcript of an NOVX gene, (vi) aberrant modification of an NOVX gene, such as of the methylation pattern of the genomic DNA, (vie) the presence of a non-wild-type splicing pattern of a messenger RNA transcript of an NOVX gene, (viii) a non-wild-type level of an NOVX protein, (ix) allelic loss of an NOVX gene, and (x) inappropriate post-translational modification of an NOVX protein. As described herein, there are a large number of assay techniques known in the art which can be used for detecting lesions in an NOVX gene. A preferred biological sample is a peripheral blood leukocyte sample isolated by conventional means from a subject. However, any biological sample containing nucleated cells may be used, including, for example, buccal mucosal cells.

In certain embodiments, detection of the lesion involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran, et al., 1988. *Science* 241: 1077–1080; and Nakazawa, et al., 1994. *Proc. Natl. Acad. Sci. USA* 91: 360–364), the latter of which can be particularly useful for detecting point mutations in the NOVX-gene (see, Abravaya, et al., 1995. *Nucl. Acids Res.* 23: 675–682). This method can include the steps of collecting a sample of cells from a patient, isolating nucleic acid (e.g., genomic, mRNA or both) from the cells of the sample, contacting the nucleic acid sample with one or more primers that specifically hybridize to an NOVX gene under conditions such that hybridization and amplification of the NOVX gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (see, Guatelli, et al., 1990. *Proc. Natl. Acad. Sci. USA* 87: 1874–1878), transcriptional amplification system (see, Kwoh, et al., 1989. *Proc. Natl. Acad. Sci. USA* 86: 1173–1177); QD Replicase (see, Lizardi, et al, 1988. *BioTechnology* 6: 1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in an NOVX gene from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, e.g., U.S. Pat. No. 5,493,531) can be used to score for the presence of specific mutations by development or loss of a ribozyme cleavage site.

In other embodiments, genetic mutations in NOVX can be identified by hybridizing a sample and control nucleic acids, e.g., DNA or RNA, to high-density arrays containing hundreds or thousands of oligonucleotides probes. See, e.g., Cronin, et al., 1996. *Human Mutation* 7: 244–255; Kozal, et al., 1996. *Nat. Med.* 2: 753–759. For example, genetic mutations in NOVX can be identified in two dimensional arrays containing light-generated DNA probes as described in Cronin, et al., supra. Briefly, a first hybridization array of probes can be used to scan through long stretches of DNA in a sample and control to identify base changes between the sequences by making linear arrays of sequential overlapping probes. This step allows the identification of point mutations. This is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the NOVX gene and detect mutations by comparing the sequence of the sample NOVX with the corresponding wild-type (control) sequence. Examples of sequencing reactions include those based on techniques developed by Maxim and Gilbert, 1977. *Proc. Natl. Acad. Sci. USA* 74: 560 or Sanger, 1977. *Proc. Natl. Acad. Sci. USA* 74: 5463. It is also contemplated that any of a variety of automated sequencing procedures can be utilized when performing the diagnostic assays (see, e.g., Naeve, et al., 1995. *Biotechniques* 19: 448), including sequencing by mass spectrometry (see, e.g., PCT International Publication No. WO 94/16101; Cohen, et al., 1996. *Adv. Chromatography* 36: 127–162; and Griffin, et al., 1993. *Appl. Biochem. Biotechnol.* 38: 147–159).

Other methods for detecting mutations in the NOVX gene include methods in which protection from cleavage agents is used to detect mismatched bases in RNA/RNA or RNA/DNA heteroduplexes. See, e.g., Myers, et al., 1985. *Science* 230: 1242. In general, the art technique of "mismatch cleavage" starts by providing heteroduplexes of formed by hybridizing (labeled) RNA or DNA containing the wild-type NOVX sequence with potentially mutant RNA or DNA obtained from a tissue sample. The double-stranded duplexes are treated with an agent that cleaves single-stranded regions of the duplex such as which will exist due to basepair mismatches between the control and sample strands. For instance, RNA/DNA duplexes can be treated with RNase and DNA/DNA hybrids treated with $S_1$ nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, e.g., Cotton, et al., 1988. *Proc. Natl. Acad. Sci. USA* 85: 4397; Saleeba, et al., 1992. *Methods Enzymol.* 217: 286–295. In an embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in NOVX cDNAs obtained from samples of cells. For example, the mutY enzyme of *E. coli* cleaves A at G/A mismatches and the thymidine DNA glycosylase from HeLa cells cleaves T at G/T mismatches. See, e.g., Hsu, et al., 1994. *Carcinogenesis* 15: 1657–1662. According to an exemplary embodiment, a probe based on an NOVX sequence, e.g., a wild-type NOVX sequence, is hybridized to a cDNA or other DNA product from a test cell(s). The duplex is treated with a DNA mismatch repair enzyme, and the cleavage products, if any, can be detected from electrophoresis protocols or the like. See, e.g., U.S. Pat. No. 5,459,039.

In other embodiments, alterations in electrophoretic mobility will be used to identify mutations in NOVX genes. For example, single strand conformation polymorphism (SSCP) may be used to detect differences in electrophoretic mobility between mutant and wild type nucleic acids. See, e.g., Orita, et al., 1989. *Proc. Natl. Acad. Sci. USA:* 86: 2766; Cotton, 1993. *Mutat. Res.* 285: 125–144; Hayashi, 1992. *Genet. Anal. Tech. Appl.* 9: 73–79. Single-stranded DNA fragments of sample and control NOVX nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In one embodiment, the subject method utilizes heteroduplex analysis to separate double stranded heteroduplex molecules on the basis of changes in electrophoretic mobility. See.e.g., Keen, et al., 1991. *Trends Genet.* 7: 5.

In yet another embodiment, the movement of mutant or wild-type fragments in polyacrylamide gels containing a gradient of denaturant is assayed using denaturing gradient gel electrophoresis (DGGE). See, e.g., Myers, et al., 1985. *Nature* 313: 495. When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA. See, e.g., Rosenbaum and Reissner, 1987. *Biophys. Chem.* 265: 12753.

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions that permit hybridization only if a perfect match is found. See, e.g., Saiki, et al., 1986. *Nature* 324: 163; Saiki, et al., 1989. *Proc. Natl. Acad. Sci. USA* 86: 6230. Such allele specific oligonucleotides are hybridized to PCR amplified target DNA or a number of different mutations when the oligonucleotides are attached to the hybridizing membrane and hybridized with labeled target DNA.

Alternatively, allele specific amplification technology that depends on selective PCR amplification may be used in conjunction with the instant invention. Oligonucleotides used as primers for specific amplification may carry the mutation of interest in the center of the molecule (so that amplification depends on differential hybridization; see, e.g., Gibbs, et al., 1989. *Nucl. Acids Res.* 17: 2437–2448) or at the extreme 3'-terminus of one primer where, under appropriate conditions, mismatch can prevent, or reduce polymerase extension (see, e.g., Prossner, 1993. *Tibtech.* 11: 238). In addition it may be desirable to introduce a novel restriction site in the region of the mutation to create cleavage-based detection. See, e.g., Gasparini, et al., 1992. *Mol. Cell Probes* 6: 1. It is anticipated that in certain embodiments amplification may also be performed using Taq ligase for amplification. See, e.g., Barany, 1991. *Proc. Natl. Acad. Sci. USA* 88: 189. In such cases, ligation will occur only if there is a perfect match at the 3'-terminus of the 5' sequence, making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving an NOVX gene.

Furthermore, any cell type or tissue, preferably peripheral blood leukocytes, in which NOVX is expressed may be utilized in the prognostic assays described herein. However, any biological sample containing nucleated cells may be used, including, for example, buccal mucosal cells.

Pharmacogenomics

Agents, or modulators that have a stimulatory or inhibitory effect on NOVX activity (e.g., NOVX gene expression), as identified by a screening assay described herein can be administered to individuals to treat (prophylactically or therapeutically) disorders (The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers.) In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the activity of NOVX protein, expression of NOVX nucleic acid, or mutation content of NOVX genes in an individual can be determined to thereby select appropriate agent(s) for therapeutic or prophylactic treatment of the individual.

Pharmacogenomics deals with clinically significant hereditary variations in the response to drugs due to altered drug disposition and abnormal action in affected persons. See, e.g., Eichelbaum, 1996. *Clin. Exp. Pharmacol. Physiol.*, 23: 983–985; Linder, 1997. *Clin. Chem.*, 43: 254–266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome PREGNANCY ZONE PROTEIN PRECURSOR enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, PM show no therapeutic response, as demonstrated for the analgesic effect of codeine mediated by its CYP2D6-formed metabolite morphine. At the other extreme are the so called ultra-rapid metabolizers who do not respond to standard doses. Recently, the molecular basis of ultra-rapid metabolism has been identified to be due to CYP2D6 gene amplification.

Thus, the activity of NOVX protein, expression of NOVX nucleic acid, or mutation content of NOVX genes in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with an NOVX modulator, such as a modulator identified by one of the exemplary screening assays described herein.

Monitoring of Effects During Clinical Trials

Monitoring the influence of agents (e.g., drugs, compounds) on the expression or activity of NOVX (e.g., the ability to modulate aberrant cell proliferation and/or differentiation) can be applied not only in basic drug screening, but also in clinical trials. For example, the effectiveness of an agent determined by a screening assay as described herein to increase NOVX gene expression, protein levels, or upregulate NOVX activity, can be monitored in clinical trails of subjects exhibiting decreased NOVX gene expression, protein levels, or downregulated NOVX activity. Alternatively, the effectiveness of an agent determined by a screening assay to decrease NOVX gene expression, protein levels, or downregulate NOVX activity, can be monitored in clinical trails of subjects exhibiting increased NOVX gene expression, protein levels, or upregulated NOVX activity. In such clinical trials, the expression or activity of NOVX and, preferably, other genes that have been implicated in, for example, a cellular proliferation or immune disorder can be used as a "read out" or markers of the immune responsiveness of a particular cell. By way of example, and not of limitation, genes, including NOVX, that are modulated in cells by treatment with an agent (e.g., compound, drug or small molecule) that modulates NOVX activity (e.g., identified in a screening assay as described herein) can be identified. Thus, to study the effect of agents on cellular proliferation disorders, for example, in a clinical trial, cells can be isolated and RNA prepared and analyzed for the levels of expression of NOVX and other genes implicated in the disorder. The levels of gene expression (i.e., a gene expression pattern) can be quantified by Northern blot analysis or RT-PCR, as described herein, or alternatively by measuring the amount of protein produced, by one of the methods as described herein, or by measuring the levels of activity of NOVX or other genes. In this manner, the gene expression pattern can serve as a marker, indicative of the physiological response of the cells to the agent. Accordingly, this response state may be determined before, and at various points during, treatment of the individual with the agent.

In one embodiment, the invention provides a method for monitoring the effectiveness of treatment of a subject with an agent (e.g., an agonist, antagonist, protein, peptide, peptidomimetic, nucleic acid, small molecule, or other drug candidate identified by the screening assays described herein) comprising the steps of (i) obtaining a pre-administration sample from a subject prior to administration of the agent; (ii) detecting the level of expression of an NOVX protein, mRNA, or genomic DNA in the preadministration sample; (iii) obtaining one or more post-administration samples from the subject; (iv) detecting the level of expression or activity of the NOVX protein, mRNA, or genomic DNA in the post-administration samples; (v) comparing the level of expression or activity of the NOVX protein, mRNA, or genomic DNA in the pre-administration sample with the NOVX protein, mRNA, or genomic DNA in the post administration sample or samples; and (vi) altering the administration of the agent to the subject accordingly. For example, increased administration of the agent may be desirable to increase the expression or activity of NOVX to higher levels than detected, ie., to increase the effectiveness of the agent. Alternatively, decreased administration of the agent may be desirable to decrease expression or activity of NOVX to lower levels than detected, i.e., to decrease the effectiveness of the agent Methods of Treatment The invention provides for both prophylactic and therapeutic methods of treating a subject at risk of (or susceptible to) a disorder or having a disorder associated with aberrant NOVX expression or activity. The disorders include cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, adrenoleukodystrophy, congenital adrenal hyperplasia, prostate cancer, neoplasm; adenocarcinoma, lymphoma, uterus cancer, fertility, hemophilia, hypercoagulation, idiopathic thrombocytopenic purpura, immunodeficiencies, graft versus host disease, AIDS, bronchial asthma, Crohn's disease; multiple sclerosis, treatment of Albright Hereditary Ostoeodystrophy, and other diseases, disorders and conditions of the like.

These methods of treatment will be discussed more fully, below.

Disease and Disorders

Diseases and disorders that are characterized by increased (relative to a subject not suffering from the disease or disorder) levels or biological activity may be treated with Therapeutics that antagonize (I.e., reduce or inhibit) activity. Therapeutics that antagonize activity may be administered in a therapeutic or prophylactic manner. Therapeutics that may be utilized include, but are not limited to: (i) an aforementioned peptide, or analogs, derivatives, fragments or homologs thereof; (ii) antibodies to an aforementioned peptide; (iii) nucleic acids encoding an aforementioned peptide; (iv) administration of antisense nucleic acid and nucleic acids that are "dysfunctional" (i.e., due to a heterologous insertion within the coding sequences of coding sequences to an aforementioned peptide) that are utilized to "knockout" endogenous function of an aforementioned peptide by homologous recombination (see, e.g., Capecchi, 1989. Science 244: 1288–1292); or (v) modulators (i.e., inhibitors, agonists and antagonists, including additional peptide mimetic of the invention or antibodies specific to a peptide of the invention) that alter the interaction between an aforementioned peptide and its binding partner.

Diseases and disorders that are characterized by decreased (relative to a subject not suffering from the disease or disorder) levels or biological activity may be treated with Therapeutics that increase (i.e., are agonists to) activity. Therapeutics that upregulate activity may be administered in a therapeutic or prophylactic manner. Therapeutics that may be utilized include, but are not limited to, an aforementioned peptide, or analogs, derivatives, fragments or homologs thereof; or an agonist that increases bioavailability.

Increased or decreased levels can be readily detected by quantifying peptide and/or RNA, by obtaining a patient tissue sample (e.g., from biopsy tissue) and assaying it in vitro for RNA or peptide levels, structure and/or activity of the expressed peptides (or mRNAs of an aforementioned peptide). Methods that are well-known within the art include, but are not limited to, immunoassays (e.g., by Western blot analysis, immunoprecipitation followed by sodium dodecyl sulfate (SDS) polyacrylamide gel electrophoresis, immunocytochemistry, etc.) and/or hybridization assays to detect expression of mRNAs (e.g., Northern assays, dot blots, in situ hybridization, and the like).

Prophylactic Methods

In one aspect, the invention provides a method for preventing, in a subject, a disease or condition associated with an aberrant NOVX expression or activity, by administering to the subject an agent that modulates NOVX expression or at least one NOVX activity. Subjects at risk for a disease that is caused or contributed to by aberrant NOVX expression or activity can be identified by, for example, any or a combination of diagnostic or prognostic assays as described herein. Administration of a prophylactic agent can occur prior to the manifestation of symptoms characteristic of the NOVX aberrancy, such that a disease or disorder is prevented or, alternatively, delayed in its progression. Depending upon the type of NOVX aberrancy, for example, an NOVX agonist or NOVX antagonist agent can be used for treating the subject. The appropriate agent can be determined based on screening assays described herein. The prophylactic methods of the invention are further discussed in the following subsections.

Therapeutic Methods

Another aspect of the invention pertains to methods of modulating NOVX expression or activity for therapeutic purposes. The modulatory method of the invention involves contacting a cell with an agent that modulates one or more of the activities of NOVX protein activity associated with the cell. An agent that modulates NOVX protein activity can be an agent as described herein, such as a nucleic acid or a protein, a naturally-occurring cognate ligand of an NOVX protein, a peptide, an NOVX peptidomimetic, or other small molecule. In one embodiment, the agent stimulates one or more NOVX protein activity. Examples of such stimulatory agents include active NOVX protein and a nucleic acid molecule encoding NOVX that has been introduced into the cell. In another embodiment, the agent inhibits one or more NOVX protein activity. Examples of such inhibitory agents include antisense NOVX nucleic acid molecules and anti-NOVX antibodies. These modulatory methods can be performed in vitro (e.g., by culturing the cell with the agent) or, alternatively, in vivo (e.g., by administering the agent to a subject). As such, the invention provides methods of treating an individual afflicted with a disease or disorder characterized by aberrant expression or activity of an NOVX protein or nucleic acid molecule. In one embodiment, the method involves administering an agent (e.g., an agent identified by a screening assay described herein), or combination of agents that modulates (e.g., up-regulates or down-regulates) NOVX expression or activity. In another embodiment, the method involves administering an NOVX protein or nucleic acid molecule as therapy to compensate for reduced or aberrant NOVX expression or activity.

Stimulation of NOVX activity is desirable in situations in which NOVX is abnormally downregulated and/or in which increased NOVX activity is likely to have a beneficial effect. One example of such a situation is where a subject has a disorder characterized by aberrant cell proliferation and/or differentiation (e.g., cancer or immune associated disorders). Another example of such a situation is where the subject has a gestational disease (e.g., preclampsia).

Determination of the Biological Effect of the Therapeutic

In various embodiments of the invention, suitable in vitro or in vivo assays are performed to determine the effect of a specific Therapeutic and whether its administration is indicated for treatment of the affected tissue.

In various specific embodiments, in vitro assays may be performed with representative cells of the type(s) involved in the patient's disorder, to determine if a given Therapeutic exerts the desired effect upon the cell type(s). Compounds for use in therapy may be tested in suitable animal model systems including, but not limited to rats, mice, chicken, cows, monkeys, rabbits, and the like, prior to testing in human subjects. Similarly, for in vivo testing, any of the animal model system known in the art may be used prior to administration to human subjects.

Prophylactic and Therapeutic Uses of the Compositions of the Invention

The NOVX nucleic acids and proteins of the invention are useful in potential prophylactic and therapeutic applications implicated in a variety of disorders including, but not limited to: metabolic disorders, diabetes, obesity, infectious disease, anorexia, cancer-associated cancer, neurodegenerative disorders, Alzheimer's Disease, Parkinson's Disorder, immune disorders, hematopoietic disorders, and the various dyslipidemias, metabolic disturbances associated with obesity, the metabolic syndrome X and wasting disorders associated with chronic diseases and various cancers.

As an example, a cDNA encoding the NOVX protein of the invention may be useful in gene therapy, and the protein may be useful when administered to a subject in need thereof. By way of non-limiting example, the compositions of the invention will have efficacy for treatment of patients suffering from: metabolic disorders, diabetes, obesity, infectious disease, anorexia, cancer-associated cachexia, cancer, neurodegenerative disorders, Alzheimer's Disease, Parkinson's Disorder, immune disorders, hematopoietic disorders, and the various dyslipidemias.

Both the novel nucleic acid encoding the NOVX protein, and the NOVX protein of the invention, or fragments thereof, may also be useful in diagnostic applications, wherein the presence or amount of the nucleic acid or the protein are to be assessed. A further use could be as an anti-bacterial molecule (i.e., some peptides have been found to possess anti-bacterial properties). These materials are further useful in the generation of antibodies, which immunospecifically-bind to the novel substances of the invention for use in therapeutic or diagnostic methods.

The invention will be further described in the following examples, which do not limit the scope of the invention described in the claims.

EXAMPLES

Example 1

Identification of NOVX Clones

The novel NOVX target sequences identified in the present invention were subjected to the exon linking process to confirm the sequence. PCR primers were designed by starting at the most upstream sequence available, for the forward primer, and at the most downstream sequence available for the reverse primer. Table 15A shows the sequences of the PCR primers used for obtaining different clones. In each case, the sequence was examined, walking inward from the respective termini toward the coding sequence, until a suitable sequence that is either unique or highly selective was encountered, or, in the case of the reverse primer, until the stop codon was reached. Such primers were designed based on in silico predictions for the full length cDNA, part (one or more exons) of the DNA or protein sequence of the target sequence, or by translated homology of the predicted exons to closely related human sequences from other species. These primers were then employed in PCR amplification based on the following pool of human cDNAs: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. Usually the resulting amplicons were gel purified, cloned and sequenced to high redundancy. The PCR product derived from exon linking was cloned into the pCR2.1 vector from Invitrogen. The resulting bacterial clone has an insert covering the entire open reading frame cloned into the pCR2.1 vector. Table 15B shows a list of these bacterial clones. The resulting sequences from all clones were assembled with themselves, with other fragments in CuraGen Corporation's database and with public ESTs. Fragments and ESTs were included as components for an assembly when the extent of their identity with another component of the assembly was at least 95% over 50 bp. In addition, sequence traces were evaluated manually and edited for corrections if appropriate. These procedures provide the sequence reported herein.

PCR). RTQ PCR was performed on an Applied Biosystems ABI PRISM® 7700 or an ABI PRISM® 7900 HT Sequence Detection System. Various collections of samples are assembled on the plates, and referred to as Panel 1 (containing normal tissues and cancer cell lines), Panel 2 (containing samples derived from tissues from normal and cancer sources), Panel 3 (containing cancer cell lines), Panel 4 (containing cells and cell lines from normal tissues and

TABLE 15A

PCR Primers for Exon Linking

| NOVX Clone | Primer 1 (5'–3') | SEQ ID NO | Primer 2 (5'–3') | SEQ ID NO |
|---|---|---|---|---|
| NOV2a and b | TCAAATGTTCAGTTTTGATTGTTGTTCTTG | 137 | TTTTTGCTAAAAGCAGCAATGCCAT | 138 |
| NOV2c | ATTGACTTATGCTTCCTAGTTCGTTGC | 139 | CAACATTTAAAAGAATGGACGATTTTCA | 140 |
| NOV2d | CTGTATTCCGGATCGATGCAAGAAG | 141 | TCTTAAGGAGAAGAAAATCTGCCGAAG | 142 |
| NOV3a | TGGAAACTCTAAAAAGCAGAGCGCCTC | 143 | CCTCTAGGTGAGTCAGTGCGTCACTCT | 144 |
| NOV6 | ATGGGGGGCCTGACAGC | 145 | TTATGTGGCACAGTCCATAGTCTGC | 146 |
| NOV8 | ATGATATGTCTTCCACATTACTGACATTCA | 147 | TTAGAGCCACAAACTAACCAGCTCAT | 148 |

Physical clone: Exons were predicted by homology and the intron/exon boundaries were determined using standard genetic rules. Exons were further selected and refined by means of similarity determination using multiple BLAST (for example, LBlastN, BlastX, and BlastN) searches, and, in some instances, GeneScan and Grail. Expressed sequences from both public and proprietary databases were also added when available to further define and complete the gene sequence. The DNA sequence was then manually corrected for apparent inconsistencies thereby obtaining the sequences encoding the full-length protein.

TABLE 15B

Physical Clones for PCR products

| NOVX Clone | Bacterial Clone |
|---|---|
| NOV1a | Physical clone: 134912642 |
| NOV1b | Physical clone: pc.253568.D11 Skin |
| NOV2b | Physical clone: 101349::AJ278717.698423.C24 FLC EL |
| NOV2c | Physical clone: 139266::Hs_S1638243.698892.A7 |
| NOV2d | Physical clone: 175223749 164837693 164830233 |
| NOV5 | Physical clone: AC007563 |
| NOV7a | Physical clone: 151818950 151176749 87413691 148439395 146025263 |
| NOV9 | Physical clone: 135008015 |
| NOV10 | Physical clone: AC010175 |
| NOV11a and b | Genomic clone: sggc_draft_ba58o1_20001005 |
| NOV12 | Genomic clone: ba370b6 |
| NOV13 | Physical clone: 139720381 |
| NOV14 | Physical clone: AC009088, 140129142 |

Example 2

Quantitative Expression Analysis of Clones in Various Cells and Tissues

The quantitative expression of various clones was assessed using microtiter plates containing RNA samples from a variety of normal and pathology-derived cells, cell lines and tissues using real time quantitative PCR (RTQ cells related to inflammatory conditions), Panel 5D/5I (containing human tissues and cell lines with an emphasis on metabolic diseases), AI_comprehensive_panel (containing normal tissue and samples from autoimmune diseases), Panel CNSD.01 (containing central nervous system samples from normal and diseased brains) and CNS_neurodegeneration panel (containing samples from normal and Alzheimer's diseased brains).

RNA integrity from all samples is controlled for quality by visual assessment of agarose gel electropherograms using 28S and 18S ribosomal RNA staining intensity ratio as a guide (2:1 to 2.5:128s: 18s) and the absence of low molecular weight RNAs that would be indicative of degradation products. Samples are controlled against genomic DNA contamination by RTQ PCR reactions run in the absence of reverse transcriptase using probe and primer sets designed to amplify across the span of a single exon.

First, the RNA samples were normalized to reference nucleic acids such as constitutively expressed genes (for example, β-actin and GAPDH). Normalized RNA (5 ul) was converted to cDNA and analyzed by RTQ-PCR using One Step RT-PCR Master Mix Reagents (Applied Biosystems; Catalog No. 4309169) and gene-specific primers according to the manufacturer's instructions.

In other cases, non-normalized RNA samples were converted to single strand cDNA (sscDNA) using Superscript II (Invitrogen Corporation; Catalog No. 18064-147) and random hexamers according to the manufacturer's instructions. Reactions containing up to 10 μg of total RNA were performed in a volume of 20 μl and incubated for 60 minutes at 42° C. This reaction can be scaled up to 50 μg of total RNA in a final volume of 100 μl. sscDNA samples are then normalized to reference nucleic acids as described previously, using 1×TaqMan® Universal Master mix (Applied Biosystems; catalog No. 4324020), following the manufacturer's instructions.

Probes and primers were designed for each assay according to Applied Biosystems Primer Express Software package (version I for Apple Computer's Macintosh Power PC) or a similar algorithm using the target sequence as input. Default settings were used for reaction conditions and the following parameters were set before selecting primers: primer concentration=250 nM, primer melting temperature (Tm) range=58°–60° C., primer optimal Tm=59° C., maximum primer difference=2° C., probe does not have 5'∝G, probe Tm must be 10° C. greater than primer Tm, amplicon size 75 bp to 100 bp. The probes and primers selected (see below) were synthesized by Synthegen (Houston, Tex., USA). Probes were double purified by HPLC to remove uncoupled dye and evaluated by mass spectroscopy to verify coupling of reporter and quencher dyes to the 5' and 3' ends of the probe, respectively. Their final concentrations were: forward and reverse primers, 900 nM each, and probe, 200 nM.

PCR conditions: When working with RNA samples, normalized RNA from each tissue and each cell line was spotted in each well of either a 96 well or a 384-well PCR plate (Applied Biosyslems). PCR cocktails included either a single gene specific probe and primers set, or two multiplexed probe and primers sets (a set specific for the target clone and another gene-specific set multiplexed with the target probe). PCR reactions were set up using TaqMan® One-Step RT-PCR Master Mix (Applied Biosystems, Catalog No. 4313803) following manufacturer's instructions. Reverse transcription was performed at 48° C. for 30 minutes followed by amplification/PCR cycles as follows: 95° C. 10 min, then 40 cycles of 95° C. for 15 seconds, 60° C. for 1 minute. Results were recorded as CT values (cycle at which a given sample crosses a threshold level of fluorescence) using a log scale, with the difference in RNA concentration between a given sample and the sample with the lowest CT value being represented as 2 to the power of delta CT. The percent relative expression is then obtained by taking the reciprocal of this RNA difference and multiplying by 100.

When working with sscDNA samples, normalized sscDNA was used as described previously for RNA samples. PCR reactions containing one or two sets of probe and primers were set up as described previously, using 1×TaqMan® Universal Master mix (Applied Biosystems; catalog No. 4324020), following the manufacturer's instructions. PCR amplification was performed as follows: 95° C. 10 min, then 40 cycles of 95° C. for 15 seconds, 60° C. for 1 minute. Results were analyzed and processed as described previously.

Panels 1, 1.1, 1.2, and 1.3D

The plates for Panels 1, 1.1, 1.2 and 10.3D include 2 control wells (genomic DNA control and chemistry control) and 94 wells containing cDNA from various samples. The samples in these panels are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in these panels are widely available through the American Type Culture Collection (ATCC), a repository for cultured cell lines, and were cultured using the conditions recommended by the ATCC. The normal tissues found on these panels are comprised of samples derived from all major organ systems from single adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose.

In the results for Panels 1, 1.1, 1.2 and 1.3D, the following abbreviations are used:
ca.=carcinoma,
*=established from metastasis,
met=metastasis,
s cell var=small cell variant,
non-s=non-sm=non-small,
squam=squamous,
pi. eff=pl effusion=pleural effusion,
glio=glioma,
astro=astrocytoma, and
neuro=neuroblastoma.

General_Screening_Panel_v1.4

The plates for Panel 1.4 include 2 control wells (genomic DNA control and chemistry control) and 94 wells containing cDNA from various samples. The samples in Panel 1.4 are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in Panel 1.4 are widely available through the American Type Culture Collection (ATCC), a repository for cultured cell lines, and were cultured using the conditions recommended by the ATCC. The normal tissues found on Panel 1.4 are comprised of pools of samples derived from all major organ systems from 2 to 5 different adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose. Abbreviations are as described for Panels 1, 1.1, 1.2, and 10.3D.

Panels 2D and 2.2

The plates for Panels 2D and 2.2 generally include 2 control wells and 94 test samples composed of RNA or cDNA isolated from human tissue procured by surgeons working in close cooperation with the National Cancer Institute's Cooperative Human Tissue Network (CHT1) or the National Disease Research Initiative (NDR1). The tissues are derived from human malignancies and in cases where indicated many malignant tissues have "matched margins" obtained from noncancerous tissue just adjacent to the tumor. These are termed normal adjacent tissues and are denoted "NAT" in the results below. The tumor tissue and the "matched margins" are evaluated by two independent pathologists (the surgical pathologists and again by a pathologist at NDR1 or CHTN). This analysis provides a gross histopathological assessment of tumor differentiation grade. Moreover, most samples include the original surgical pathology report that provides information regarding the clinical stage of the patient. These matched margins are taken from the tissue surrounding (i.e. immediately proximal) to the zone of surgery (designated "NAT", for normal adjacent tissue, in Table RR). In addition, RNA and cDNA samples were obtained from various human tissues derived from autopsies performed on elderly people or sudden death victims (accidents, etc.). These tissues were ascertained to be free of disease and were purchased from various commercial sources such as Clontech (Palo Alto, Calif.), Research Genetics, and Invitrogen.

Panel 3D

The plates of Panel 3D are comprised of 94 cDNA samples and two control samples. Specifically, 92 of these samples are derived from cultured human cancer cell lines, 2 samples of human primary cerebellar tissue and 2 controls. The human cell lines are generally obtained from ATCC (American Type Culture Collection), NCI or the German tumor cell bank and fall into the following tissue groups: Squamous cell carcinoma of the tongue, breast cancer, prostate cancer, melanoma, epidermoid carcinoma, sarcomas, bladder carcinomas, pancreatic cancers, kidney cancers, leukemias/lymphomas, ovarian/uterine/cervical, gastric, colon, lung and CNS cancer cell lines. In addition, there are two independent samples of cerebellum. These cells are all cultured under standard recommended conditions and RNA extracted using the standard procedures. The cell lines in panel 3D and 1.3D are of the most common cell lines used in the scientific literature.

Panels 4D, 4R, and 4.1D

Panel 4 includes samples on a 96 well plate (2 control wells, 94 test samples) composed of RNA (Panel 4R) or cDNA (Panels 4D/4.1 D) isolated from various human cell lines or tissues related to inflammatory conditions. Total RNA from control normal tissues such as colon and lung (Stratagene, La Jolla, Calif.) and thymus and kidney (Clontech) was employed. Total RNA from liver tissue from cirrhosis patients and kidney from lupus patients was obtained from BioChain (Biochain Institute, Inc., Hayward, Calif.). Intestinal tissue for RNA preparation from patients diagnosed as having Crohn's disease and ulcerative colitis was obtained from the National Disease Research Interchange (NDR1) (Philadelphia, Pa.).

Astrocytes, lung fibroblasts, dermal fibroblasts, coronary artery smooth muscle cells, small airway epithelium, bronchial epithelium, microvascular dermal endothelial cells, microvascular lung endothelial cells, human pulmonary aortic endothelial cells, human umbilical vein endothelial cells were all purchased from Clonetics (Walkersville, Md.) and grown in the media supplied for these cell types by Clonetics. These primary cell types were activated with various cytokines or combinations of cytokines for 6 and/or 12–14 hours, as indicated. The following cytokines were used; IL-1 beta at approximately 1–5 ng/ml, TNF alpha at approximately 5–10 ng/ml, IFN gamma at approximately 20–50 ng/ml, IL-4 at approximately 5–10 ng/ml, IL-9 at approximately 5–10 ng/ml, IL-13 at approximately 5–10 ng/ml. Endothelial cells were sometimes starved for various times by culture in the basal media from Clonetics with 0.1% serum.

Mononuclear cells were prepared from blood of employees at CuraGen Corporation, using Ficoll. LAK cells were prepared from these cells by culture in DMEM 5% FCS (Hyclone), 100 $\mu$M non essential amino acids (Gibco/Life Technologies, Rockville, Md.), 1 mM sodium pyruvate (Gibco), mercaptoethanol $5.5\times10^{-5}$M (Gibco), and 10 mM Hepes (Gibco) and Interleukin 2 for 4–6 days. Cells were then either activated with 1020 ng/ml PMA and 1–2 $\mu$g/ml ionomycin, IL-12 at 5–10 ng/ml, IFN gamma at 20–50 ng/ml and IL-18 at 5–10 ng/ml for 6 hours. In some cases, mononuclear cells were cultured for 4–5 days in DMEM 5% FCS (Hyclone), 1001M non essential amino acids (Gibco), 1 mM sodium pyruvate (Gibco), mercaptoethanol $5.5\times10^{-5}$ M (Gibco), and 10 mM Hepes (Gibco) with PHA (phytohemagglutinin) or PWM (pokeweed mitogen) at approximately 5 $\mu$g/ml. Samples were taken at 24, 48 and 72 hours for RNA preparation. MLR (mixed lymphocyte reaction) samples were obtained by taking blood from two donors, isolating the mononuclear cells using Ficoll and mixing the isolated mononuclear cells 1:1 at a final concentration of approximately $2\times10^6$ cells/ml in DMEM 5% FCS (Hyclone), 100 $\mu$M non essential amino acids (Gibco), 1 mM sodium pyruvate (Gibco), mercaptoethanol ($5.5\times10^{-5}$ M) (Gibco), and 10 mM Hepes (Gibco). The MLR was cultured and samples taken at various time points ranging from 1–7 days for RNA preparation.

Monocytes were isolated from mononuclear cells using CD14 Miltenyi Beads, +ve VS selection columns and a Vario Magnet according to the manufacturer's instructions. Monocytes were differentiated into dendritic cells by culture in DMEM 5% fetal calf serum (FCS) (Hyclone, Logan, Utah), 100 $\mu$M non essential amino acids (Gibco), 1 mM sodium pyruvate (Gibco), mercaptoethanol $5.5\times10^5$M (Gibco), and 10 mM Hepes (Gibco), 50 ng/ml GMCSF and 5 ng/ml IL-4 for 5–7 days. Macrophages were prepared by culture of monocytes for 5–7 days in DMEM 5% FCS (Hyclone), 100 $\mu$M non essential amino acids (Gibco), 1 mM sodium pyruvate (Gibco), mercaptoethanol $5.5\times10^5$M (Gibco), 10 mM Hepes (Gibco) and 10% AB Human Serum or MCSF at approximately 50 ng/ml. Monocytes, macrophages and dendritic cells were stimulated for 6 and 12–14 hours with lipopolysaccharide (LPS) at 100 ng/ml. Dendritic cells were also stimulated with anti-CD40 monoclonal antibody (Pharmingen) at 10 g/ml for 6 and 12–14 hours.

CD4 lymphocytes, CD8 lymphocytes and NK cells were also isolated from mononuclear cells using CD4, CD8 and CD56 Miltenyi beads, positive VS selection columns and a Vario Magnet according to the manufacturer's instructions. CD45RA and CD45RO CD4 lymphocytes were isolated by depleting mononuclear cells of CD8, CD56, CD14 and CD19 cells using CD8, CD56, CD 14 and CD 19 Miltenyi beads and positive selection. CD45RO beads were then used to isolate the CD45RO CD4 lymphocytes with the remaining cells being CD45RA CD4 lymphocytes. CD45RA CD4, CD45RO CD4 and CD8 lymphocytes were placed in DMEM 5% FCS (Hyclone), 100 $\mu$M non essential amino acids (Gibco), 1 mM sodium pyruvate (Gibco), mercaptoethanol $5.5\times10^{15}$M (Gibco), and 10 mM Hepes (Gibco) and plated at $10^6$cells/ml onto Falcon 6 well tissue culture plates that had been coated overnight with 0.5 $\mu$g/ml anti-CD28 (Pharmingen) and 3 $\mu$g/ml anti-CD3 (OKT3, ATCC) in PBS. After 6 and 24 hours, the cells were harvested for RNA preparation. To prepare chronically activated CD8 lymphocytes, we activated the isolated CD8 lymphocytes for 4 days on anti-CD28 and anti-CD3 coated plates and then harvested the cells and expanded them in DMEM 5% FCS (Hyclone), 100 $\mu$M non essential amino acids (Gibco), 1 mM sodium pyruvate (Gibco), mercaptoethanol $5.5\times10^{-5}$M (Gibco), and 10 mM Hepes (Gibco) and IL-2. The expanded CD8 cells were then activated again with plate bound anti-CD3 and anti-CD28 for 4 days and expanded as before. RNA was isolated 6 and 24 hours after the second activation and after 4 days of the second expansion culture. The isolated NK cells were cultured in DMEM 5% FCS (Hyclone), 100 $\mu$M non essential amino acids (Gibco), 1 mM sodium pyruvate (Gibco), mercaptoethanol $5.5\times10^{-5}$M (Gibco), and 10 mM Hepes (Gibco) and IL-2 for 4–6 days before RNA was prepared.

To obtain B cells, tonsils were procured from NDR1. The tonsil was cut up with sterile dissecting scissors and then passed through a sieve. Tonsil cells were then spun down and resupended at $10^6$ cells/ml in DMEM 5% FCS (Hyclone), 100 μM non essential amino acids (Gibco), 1 mM sodium pyruvate (Gibco), mercaptoethanol $5.5 \times 10^{-5}$M (Gibco), and 10 mM Hepes (Gibco). To activate the cells, we used PWM at 5 μg/ml or anti-CD40 (Pharmingen) at approximately 10 μg/ml and IL-4 at 5–10 ng/ml. Cells were harvested for RNA preparation at 24, 48 and 72 hours.

To prepare the primary and secondary Th1/Th2 and Tr1 cells, six-well Falcon plates were coated overnight with 10 μg/ml anti-CD28 (Pharmingen) and 2 μg/ml OKT3 (ATCC), and then washed twice with PBS. Umbilical cord blood CD4 lymphocytes (Poietic Systems, German Town, Md.) were cultured at $10^5$–$10^6$ cells/ml in DMEM 5% FCS (Hyclone), 100 μM non essential amino acids (Gibco), 1 mM sodium pyruvate (Gibco), mercaptoethanol $5.5 \times 10^{-5}$M (Gibco), 10 mM Hepes (Gibco) and IL-2 (4 ng/ml). IL-12 (5 ng/ml) and anti-IL-4 (1 μg/ml) were used to direct to Th1, while IL-4 (5 ng/ml) and anti-IFN gamma (1 μg/ml) were used to direct to Th2 and IL-10 at 5 ng/ml was used to direct to Tr1. After 4–5 days, the activated Th1, Th2 and Tr1 lymphocytes were washed once in DMEM and expanded for 4–7 days in DMEM 5% FCS (Hyclone), 100 μM non essential amino acids (Gibco), 1 mM sodium pyruvate (Gibco), mercapto-ethanol $5.5 \times 10^5$M (Gibco), 10 mM Hepes (Gibco) and IL-2 (1 ng/ml). Following this, the activated Th1, Th2 and Tr1 lymphocytes were re-stimulated for 5 days with anti-CD28/OKT3 and cytokines as described above, but with the addition of anti-CD95L (Il g/ml) to prevent apoptosis. After 4–5 days, the Th1, Th2 and Tr1 lymphocytes were washed and then expanded again with IL-2 for 47 days. Activated Th1 and Th2 lymphocytes were maintained in this way for a maximum of three cycles. RNA was prepared from primary and secondary Th1, Th2 and Tr1 after 6 and 24 hours following the second and third activations with plate bound anti-CD3 and anti-CD28 mAbs and 4 days into the second and third expansion cultures in Interleukin 2.

The following leukocyte cells lines were obtained from the ATCC: Ramos, EOL-1, KU-812. EOL cells were further differentiated by culture in 0.1 mM dbcAMP at $5 \times 10^5$ cells/ml for 8 days, changing the media every 3 days and adjusting the cell concentration to $5 \times 10^5$ cells/ml. For the culture of these cells, we used DMEM or RPMI (as recommended by the ATCC), with the addition of 5% FCS (Hyclone), 1001M non essential amino acids (Gibco), 1 mM sodium pyruvate (Gibco), mercaptoethanol $5.5 \times 10^{-5}$M (Gibco), 10 mM Hepes (Gibco). RNA was either prepared from resting cells or cells activated with PMA at 10 ng/ml and ionomycin at 1 μg/ml for 6 and 14 hours. Keratinocyte line CCD106 and an airway epithelial tumor line NC1—H292 were also obtained from the ATCC. Both were cultured in DMEM 5% FCS (Hyclone), 100 μM non essential amino acids (Gibco), 1 mM sodium pyruvate (Gibco), mercaptoethanol $5.5 \times 10^5$M (Gibco), and 10 mM Hepes (Gibco). CCD1106 cells were activated for 6 and 14 hours with approximately 5 ng/ml TNF alpha and 1 ng/ml IL-1 beta, while NCI-H292 cells were activated for 6 and 14 hours with the following cytokines: 5 ng/ml IL-4, 5 ng/ml IL-9, 5 ng/ml IL-13 and 25 ng/ml IFN gamma.

For these cell lines and blood cells, RNA was prepared by lysing approximately $10^7$ cells/ml using Trizol (Gibco BRL). Briefly, 1/10 volume of bromochloropropane (Molecular Research Corporation) was added to the RNA sample, vortexed and after 10 minutes at room temperature, the tubes were spun at 14,000 rpm in a Sorvall SS34 rotor. The aqueous phase was removed and placed in a 15 ml Falcon Tube. An equal volume of isopropanol was added and left at $-20°$ C. overnight. The precipitated RNA was spun down at 9,000 rpm for 15 min in a Sorvall SS34 rotor and washed in 70% ethanol. The pellet was redissolved in 300 μl of RNAse-free water and 35 μl buffer (Promega) 5 μl DTT, 7 μl RNAsin and 8 μl DNAse were added. The tube was incubated at 37° C. for 30 minutes to remove contaminating genomic DNA, extracted once with phenol chloroform and re-precipitated with 1/10 volume of 3M sodium acetate and 2 volumes of 100% ethanol. The RNA was spun down and placed in RNAse free water. RNA was stored at $-80°$ C.

AI_comprehensive panel_v1.0

The plates for AI_comprehensive panel_v1.0 include two control wells and 89 test samples comprised of cDNA isolated from surgical and postmortem human tissues obtained from the Backus Hospital and Clinomics (Frederick, Md.). Total RNA was extracted from tissue samples from the Backus Hospital in the Facility at CuraGen. Total RNA from other tissues was obtained from Clinomics.

Joint tissues including synovial fluid, synovium, bone and cartilage were obtained from patients undergoing total knee or hip replacement surgery at the Backus Hospital. Tissue samples were immediately snap frozen in liquid nitrogen to ensure that isolated RNA was of optimal quality and not degraded. Additional samples of osteoarthritis and rheumatoid arthritis joint tissues were obtained from Clinomics. Normal control tissues were supplied by Clinomics and were obtained during autopsy of trauma victims.

Surgical specimens of psoriatic tissues and adjacent matched tissues were provided as total RNA by Clinomics. Two male and two female patients were selected between the ages of 25 and 47. None of the patients were taking prescription drugs at the time samples were isolated.

Surgical specimens of diseased colon from patients with ulcerative colitis and Crohns disease and adjacent matched tissues were obtained from Clinomics. Bowel tissue from three female and three male Crohn's patients between the ages of 41–69 were used. Two patients were not on prescription medication while the others were taking dexamethasone, phenobarbital, or tylenol. Ulcerative colitis tissue was from three male and four female patients. Four of the patients were taking lebvid and two were on phenobarbital.

Total RNA from post mortem lung tissue from trauma victims with no disease or with emphysema, asthma or COPD was purchased from Clinomics. Emphysema patients ranged in age from 40–70 and all were smokers, this age range was chosen to focus on patients with cigarette-linked emphysema and to avoid those patients with alpha-] antitrypsin deficiencies. Asthma patients ranged in age from 36–75, and excluded smokers to prevent those patients that could also have COPD. COPD patients ranged in age from 35–80 and included both smokers and non-smokers. Most patients were taking corticosteroids, and bronchodilators.

In the labels employed to identify tissues in the AI_comprehensive panel_v.1.0 panel, the following abbreviations are used:

AI=Autoimmunity
Syn Synovial
Normal=No apparent disease
Rep22/Rep20=individual patients
RA=Rheumatoid arthritis
Backus From Backus Hospital
OA=Osteoarthritis
(SS) (BA) (MF)=Individual patients
Adj=Adjacent tissue
Match control=adjacent tissues −M=Male
−F=Female
COPD=Chronic obstructive pulmonary disease
Panels 5D and 5I The plates for Panel 5D and 5I include two control wells and a variety of cDNAs isolated from human tissues and cell lines with an emphasis on metabolic diseases. Metabolic tissues were obtained from patients enrolled in the Gestational Diabetes study. Cells were obtained during different stages in the differentiation of adipocytes from human mesenchymal stem cells. Human pancreatic islets were also obtained.

In the Gestational Diabetes study subjects are young (18–40 years), otherwise healthy women with and without gestational diabetes undergoing routine (elective) Caesarean section. After delivery of the infant, when the surgical incisions were being repaired/closed, the obstetrician removed a small sample (<1 cc) of the exposed metabolic tissues during the closure of each surgical level. The biopsy material was rinsed in sterile saline, blotted and fast frozen within 5 minutes from the time of removal. The tissue was then flash frozen in liquid nitrogen and stored, individually, in sterile screw-top tubes and kept on dry ice for shipment to or to be picked up by CuraGen. The metabolic tissues of interest include uterine wall (smooth muscle), visceral adipose, skeletal muscle (rectus) and subcutaneous adipose. Patient descriptions are as follows:

| Patient 2 | Diabetic Hispanic, overweight, not on insulin |
| Patient 7–9 | Nondiabetic Caucasian and obese (BMI > 30) |
| Patient 10 | Diabetic Hispanic, overweight, on insulin |
| Patient 11 | Nondiabetic African American and overweight |
| Patient 12 | Diabetic Hispanic on insulin |

Adipocyte differentiation was induced in donor progenitor cells obtained from Osirus (a division of Clonetics/BioWhittaker) in triplicate, except for Donor 3U which had only two replicates. Scientists at Clonetics isolated, grew and differentiated human mesenchymal stem cells (HuMSCs) for CuraGen based on the published protocol found in Mark F. Pittenger, et al., Multilineage Potential of Adult Human Mesenchymal Stem Cells Science Apr. 2 1999: 143–147. Clonetics provided Trizol lysates or frozen pellets suitable for mRNA isolation and ds cDNA production. A general description of each donor is as follows:

Donor 2 and 3 U: Mesenchymal Stem cells, Undifferentiated Adipose
Donor 2 and 3 AM: Adipose, AdiposeMidway Differentiated
Donor 2 and 3 AD: Adipose, Adipose Differentiated Human cell lines were generally obtained from ATCC (American Type Culture Collection), NCI or the German tumor cell bank and fall into the following tissue groups: kidney proximal convoluted tubule, uterine smooth muscle cells, small intestine, liver HepG2 cancer cells, heart primary stromal cells, and adrenal cortical adenoma cells. These cells are all cultured under standard recommended conditions and RNA extracted using the standard procedures. All samples were processed at CuraGen to produce single stranded cDNA.

Panel 5S contains all samples previously described with the addition of pancreatic islets from a 58 year old female patient obtained from the Diabetes Research Institute at the University of Miami School of Medicine. Islet tissue was processed to total RNA at an outside source and delivered to CuraGen for addition to panel 5T.

In the labels employed to identify tissues in the 5D, and 5I panels, the following abbreviations are used:
GO Adipose=Greater Omentum Adipose
SK=Skeletal Muscle
UT=Uterus
PL=Placenta
AD=Adipose Differentiated
AM=Adipose Midway Differentiated
U=Undifferentiated Stem Cells
Panel CNSD.01

The plates for Panel CNSD.01 include two control wells and 94 test samples comprised of cDNA isolated from postmortem human brain tissue obtained from the Harvard Brain Tissue Resource Center. Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains two brains from each of the following diagnoses: Alzheimer's disease, Parkinson's disease, Huntington's disease, Progressive Supernuclear Palsy, Depression, and "Normal controls". Within each of these brains, the following regions are represented: cingulate gyrus, temporal pole, globus palladus, substantia nigra, Brodman Area 4 (primary motor strip), Brodman Area 7 (parietal cortex), Brodman Area 9 (prefrontal cortex), and Brodman area 17 (occipital cortex). Not all brain regions are represented in all cases; e.g., Huntington's disease is characterized in part by neurodegeneration in the globus palladus, thus this region is impossible to obtain from confirmed Huntington's cases. Likewise Parkinson's disease is characterized by degeneration of the substantia nigra making this region more difficult to obtain. Normal control brains were examined for neuropathology and found to be free of any pathology consistent with neurodegeneration.

In the labels employed to identify tissues in the CNS panel, the following abbreviations are used:
PSP=Progressive supranuclear palsy
Sub Nigra=Substantia nigra
Glob Palladus=Globus palladus
Temp Pole=Temporal pole
Cing Gyr=Cingulate gyrus
BA 4=Brodman Area 4
Panel CNS_Neurodegeneration_V1.0

The plates for Panel CNS Neurodegeneration_V 0.0 include two control wells and 47 test samples comprised of cDNA isolated from postmortem human brain tissue obtained from the Harvard Brain Tissue Resource Center (McLean Hospital) and the Human Brain and Spinal Fluid Resource Center (VA Greater Los Angeles Healthcare System). Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains six brains from Alzheimer's disease (AD) patients, and eight brains from "Normal controls" who showed no evidence of dementia prior to death. The eight normal control brains are divided into two categories: Controls with no dementia and no Alzheimer's like pathology (Controls) and controls with no dementia but evidence of severe Alzheimer's like pathology, (specifically senile plaque load rated as level 3 on a scale of 0–3; 0=no evidence of plaques, 3=severe AD senile plaque load). Within each of these brains, the following regions are represented: hippocampus, temporal cortex (Brodman Area 21), parietal cortex (Brodman area 7), and occipital cortex (Brodman area 17). These regions were chosen to encompass all levels of neurodegeneration in AD. The hippocampus is a region of early and severe neuronal loss in AD; the temporal cortex is known to show neurodegeneration in AD after the hippocampus; the parietal cortex shows moderate neuronal death in the late stages of the disease; the occipital cortex is spared in AD and therefore acts as a "control" region within AD patients. Not all brain regions are represented in all cases.

In the labels employed to identify tissues in the CNS_Neurodegeneration_V1.0 panel, the following abbreviations are used:

AD=Alzheimer's disease brain; patient was demented and showed AD-like pathology upon autopsy Control=Control brains; patient not demented, showing no neuropathology Control (Path)=Control brains; pateint not demented but showing sever AD-like pathology SupTemporal Ctx=Superior Temporal Cortex Inf Temporal Ctx=Inferior Temporal Cortex

NOV4

Expression of gene NOV4 was assessed using the primer-probe set Ag3802, described in Table 16.

TABLE 16

Probe Name Ag3802

| Primers | Sequences | Length | Start Position | SEQ ID NO: |
|---|---|---|---|---|
| Forward | 5'-gtcgatgggacatctttcct-3' | 20 | 108 | 149 |
| Probe | TET-5'-cttcggatcactatcatccagtgcca-3'-TAMRA | 26 | 134 | 150 |
| Reverse | 5'-atgaggaagtagcccacgtt-3' | 20 | 171 | 151 |

General_screening_panel_v1.4 Summary: Ag3082 Expression of the NOV4 gene is low/undetectable in all samples on this panel (CTs>35). (Data not shown.) The data suggest that these expression levels may be due to a probe failure.

NOV3a and NOV3b

Expression of gene NOV3a and variant NOV3b was assessed using the primer-probe set Ag4849, described in Table 17. Results of the RTQ-PCR runs are shown in Tables 18 and 19.

TABLE 17

Probe Name Ag4849

| Primers | Sequences | Length | Start Position | SEQ ID NO: |
|---|---|---|---|---|
| Forward | 5'-gccagttctacctcaagttcct-3' | 22 | 3895 | 152 |
| Probe | TET-5'-ctaccaccatgtgtcccgccgttt-3'-TAMRA | 24 | 3920 | 153 |
| Reverse | 5'-catagtcagagtcgagcaggaa-3' | 22 | 3951 | 154 |

TABLE 18

General_screening_panel_v1.5

| Tissue Name | Rel. Exp. (%) Ag4849, Run 228887477 | Tissue Name | Rel. Exp. (%) Ag4849, Run 228887477 |
|---|---|---|---|
| Adipose | 8.4 | Renal ca. TK-10 | 31.2 |
| Melanoma* Hs688(A).T | 32.5 | Bladder | 18.6 |
| Melanoma* Hs688(B).T | 37.4 | Gastric ca. (liver met.) NCI-N87 | 76.8 |
| Melanoma* M14 | 58.2 | Gastric ca. KATO III | 75.8 |
| Melanoma* LOXIMVI | 15.5 | Colon ca. SW-948 | 25.2 |
| Melanoma* SK-MEL-5 | 45.4 | Colon ca. SW480 | 55.9 |

TABLE 18-continued

General_screening_panel_v1.5

| Tissue Name | Rel. Exp. (%) Ag4849, Run 228887477 | Tissue Name | Rel. Exp. (%) Ag4849, Run 228887477 |
|---|---|---|---|
| Squamous cell carcinoma SCC-4 | 17.0 | Colon ca.* (SW480 met) SW620 | 25.5 |
| Testis Pool | 30.1 | Colon ca. HT29 | 17.2 |
| Prostate ca.* (bone met) PC-3 | 40.3 | Colon ca. HCT-116 | 36.1 |
| Prostate Pool | 7.4 | Colon ca. CaCo-2 | 29.5 |
| Placenta | 17.2 | Colon cancer tissue | 20.9 |
| Uterus Pool | 4.9 | Colon ca. SW1116 | 11.3 |
| Ovarian ca. OVCAR-3 | 24.5 | Colon ca. Colo-205 | 28.9 |
| Ovarian ca. SK-OV-3 | 71.2 | Colon ca. SW-48 | 14.0 |
| Ovarian ca. OVCAR-4 | 30.1 | Colon Pool | 15.1 |
| Ovarian ca. OVCAR-5 | 32.8 | Small Intestine Pool | 13.1 |
| Ovarian ca. IGROV-1 | 19.9 | Stomach Pool | 7.4 |
| Ovarian ca. OVCAR-8 | 21.2 | Bone Marrow Pool | 7.9 |
| Ovary | 15.0 | Fetal Heart | 9.6 |
| Breast ca. MCF-7 | 13.9 | Heart Pool | 7.3 |
| Breast ca. MDA-MB-231 | 38.4 | Lymph Node Pool | 16.5 |
| Breast ca. BT 549 | 61.1 | Fetal Skeletal Muscle | 9.8 |
| Breast ca. T47D | 7.3 | Skeletal Muscle Pool | 29.1 |
| Breast ca. MDA-N | 17.0 | Spleen Pool | 9.0 |
| Breast Pool | 14.5 | Thymus Pool | 17.3 |
| Trachea | 13.2 | CNS cancer (glio/astro) U87-MG | 56.3 |
| Lung | 2.6 | CNS cancer (glio/astro) U-118-MG | 67.4 |
| Fetal Lung | 25.5 | CNS cancer (neuro;met) SK-N-AS | 18.6 |
| Lung ca. NCI-N417 | 13.9 | CNS cancer (astro) SF-539 | 21.0 |
| Lung ca. LX-1 | 37.9 | CNS cancer (astro) SNB-75 | 69.7 |
| Lung ca. NCI-H146 | 9.6 | CNS cancer (glio) SNB-19 | 14.3 |
| Lung ca. SHP-77 | 34.9 | CNS cancer (glio) SF-295 | 80.7 |
| Lung ca. A549 | 19.3 | Brain (Amygdala) Pool | 32.1 |
| Lung ca. NCI-H526 | 16.6 | Brain (cerebellum) | 100.0 |
| Lung ca. NCI-H23 | 25.2 | Brain (fetal) | 61.1 |
| Lung ca. NCI-H460 | 23.7 | Brain (Hippocampus) Pool | 28.9 |
| Lung ca. HOP-62 | 24.1 | Cerebral Cortex Pool | 32.1 |
| Lung ca. NCI-H522 | 17.3 | Brain (Substantia nigra) Pool | 46.3 |
| Liver | 2.5 | Brain (Thalamus) Pool | 47.3 |
| Fetal Liver | 17.4 | Brain (whole) | 41.8 |
| Liver ca. HepG2 | 19.6 | Spinal Cord Pool | 18.2 |
| Kidney Pool | 27.2 | Adrenal Gland | 18.3 |
| Fetal Kidney | 8.9 | Pituitary gland Pool | 4.1 |
| Renal ca. 786-0 | 18.8 | Salivary Gland | 7.9 |
| Renal ca. A498 | 8.5 | Thyroid (female) | 15.7 |
| Renal ca. ACHN | 24.3 | Pancreatic ca. CAPAN2 | 28.1 |
| Renal ca. UO-31 | 19.2 | Pancreas Pool | 19.5 |

TABLE 19

Panel 4.1D

| Tissue Name | Rel. Exp. (%) Ag4849, Run 223335772 | Tissue Name | Rel. Exp. (%) Ag4849, Run 223335772 |
|---|---|---|---|
| Secondary Th1 act | 66.9 | HUVEC IL-1beta | 26.8 |
| Secondary Th2 act | 62.4 | HUVEC IFN gamma | 21.3 |
| Secondary Tr1 act | 65.5 | HUVEC TNFalpha + IFN gamma | 29.3 |

TABLE 19-continued

Panel 4.1D

| Tissue Name | Rel. Exp. (%) Ag4849, Run 223335772 | Tissue Name | Rel. Exp. (%) Ag4849, Run 223335772 |
|---|---|---|---|
| Secondary Th1 rest | 36.9 | HUVEC TNFalpha + IL4 | 24.7 |
| Secondary Th2 rest | 44.8 | HUVEC IL-11 | 20.4 |
| Secondary Tr1 rest | 33.0 | Lung Microvascular EC none | 34.2 |
| Primary Th1 act | 56.6 | Lung Microvascular EC TNF alpha + IL-1beta | 39.2 |
| Primary Th2 act | 51.8 | Microvascular Dermal EC none | 18.3 |
| Primary Tr1 act | 50.7 | Microsvascular Dermal EC TNFalpha + IL-1beta | 22.8 |
| Primary Th1 rest | 32.5 | Bronchial epithelium TNFalpha + IL1beta | 41.5 |
| Primary Th2 rest | 32.8 | Small airway epithelium none | 23.5 |
| Primary Tr1 rest | 49.3 | Small airway epithelium TNFalpha + IL-1beta | 36.6 |
| CD45RA CD4 lymphocyte act | 55.5 | Coronery artery SMC rest | 19.3 |
| CD45RO CD4 lymphocyte act | 57.0 | Coronery artery SMC TNFalpha + IL-1beta | 26.1 |
| CD8 lymphocyte act | 73.7 | Astrocytes rest | 22.5 |
| Secondary CD8 lymphocyte rest | 62.4 | Astrocytes TNFalpha + IL-1beta | 13.5 |
| Secondary CD8 lymphocyte act | 48.6 | KU-812 (Basophil) rest | 19.3 |
| CD4 lymphocyte none | 29.7 | KU-812 (Basophil) PMA/ionomycin | 28.3 |
| 2ry Th1/Th2/Tr1_anti-CD95 CH11 | 61.1 | CCD1106 (Keratinocytes) none | 29.3 |
| LAK cells rest | 47.3 | CCD1106 (Keratinocytes) TNFalpha + IL-1beta | 31.6 |
| LAK cells IL-2 | 55.9 | Liver cirrhosis | 4.6 |
| LAK cells IL-2 + IL-12 | 43.5 | NCI-H292 none | 9.9 |
| LAK cells IL-2 + IFN gamma | 53.6 | NCI-H292 IL-4 | 16.6 |
| LAK cells IL-2 + IL-18 | 48.6 | NCI-H292 IL-9 | 20.0 |
| LAK cells PMA/ionomycin | 35.6 | NCI-H292 IL-13 | 19.9 |
| NK Cells IL-2 rest | 100.0 | NCI-H292 IFN gamma | 15.9 |
| Two Way MLR 3 day | 65.5 | HPAEC none | 16.6 |
| Two Way MLR 5 day | 47.6 | HPAEC TNFalpha + IL-1 beta | 38.4 |
| Two Way MLR 7 day | 35.1 | Lung fibroblast none | 43.2 |
| PBMC rest | 28.7 | Lung fibroblast TNFalpha + IL-1 beta | 34.4 |
| PBMC PWM | 59.5 | Lung fibroblast IL-4 | 53.2 |
| PBMC PHA-L | 58.6 | Lung fibroblast IL-9 | 29.3 |
| Ramos (B cell) none | 80.1 | Lung fibroblast IL-13 | 33.4 |
| Ramos (B cell) ionomycin | 79.6 | Lung fibroblast IFN gamma | 49.0 |
| B lymphocytes PWM | 31.9 | Dermal fibroblast CCD1070 rest | 45.7 |
| B lymphocytes CD40L and IL-4 | 82.9 | Dermal fibroblast CCD1070 TNF alpha | 64.6 |
| EOL-1 dbcAMP | 33.0 | Dermal fibroblast CCD1070 IL-1beta | 35.4 |
| EOL-1 dbcAMP PMA/ionomycin | 42.6 | Dermal fibroblast IFN gamma | 34.6 |
| Dendritic cells none | 31.6 | Dermal fibroblast IL-4 | 51.1 |
| Dendritic cells LPS | 20.2 | Dermal fibroblast rest | 39.2 |
| Dendritic cells anti-CD40 | 27.7 | Neutrophils TNFa + LPS | 7.7 |
| Monocytes rest | 15.5 | Neutrophils rest | 14.3 |
| Monocytes LPS | 52.1 | Colon | 15.9 |
| Macrophages rest | 34.4 | Lung | 12.9 |
| Macrophages LPS | 14.8 | Thymus | 69.7 |
| HUVEC none | 23.5 | Kidney | 29.5 |
| HUVEC starved | 26.6 | | |

General_screening_panel_v1.5 Summary: Ag4849 The NOV3a gene is a splice variant of SET-binding factor and is moderately expressed in all tissues and cell lines in this panel. The ubiquitous expression of this gene suggests a role in cell survival and proliferation. As demonstrated in the abstract below, this gene may regulate the activity of other genes by direct interaction. In addition, highest expression of this gene in this panel is seen in the brain, with high levels of expression detected in all regions of the brain examined. Since SBF proteins are believed to play a role in the cell cycle, this protein may be of use in neural stem cell therapy, specifically in controlling the transition of stem cells to post mitotic neurons.

REFERENCES

Firestein R, Cui X, fluie P, Cleary M L. Set domain-dependent regulation of transcriptional silencing and growth control by SUV39H1, a mammalian ortholog of Drosophila Su(var)3–9. Mol Cell Biol 2000 July;20(13):4900–9

Mammalian SET domain-containing proteins define a distinctive class of chromatin-associated factors that are targets for growth control signals and oncogenic activation. SUV39H I, a mammalian ortholog of Drosophila Su(var) 3–9, contains both SET and chromo domains, signature motifs for proteins that contribute to epigenetic control of gene expression through effects on the regional organization of chromatin structure. In this report we demonstrate that SUV39H1 represses transcription in a transient transcriptional assay when tethered to DNA through the GALA DNA binding domain. Under these conditions, SUV39H1 displays features of a long-range repressor capable of acting over several kilobases to silence basal promoters. A possible role in chromatin-mediated gene silencing is supported by the localization of exogenously expressed SUV39H1 to nuclear bodies with morphologic features suggestive of heterochromatin in interphase cells. In addition, we show that SUV39H1 is phosphorylated specifically at the G(I)/S cell cycle transition and when forcibly expressed suppresses cell growth. Growth suppression as well as the ability of SUV39H1 to form nuclear bodies and silence transcription are antagonized by the oncogenic antiphosphatase Sbf1 that when hyperexpressed interacts with the SET domain and stabilizes the phosphorylated form of SUV39H1. These studies suggest a phosphorylation-dependent mechanism for regulating the chromatin organizing activity of a mammalian su(var) protein and implicate the SET domain as a gatekeeper motif that integrates upstream signaling pathways to epigenetic regulation and growth control.

Cui X, De Vivo I, Slany R, Miyamoto A, Firestein R, Cleary M L. Nat Genet 1998 April; 18(4):331-i; Association of SET domain and myotubularin-related proteins modulates growth control.

Several proteins that contribute to epigenetic mechanisms of gene regulation contain a characteristic motif of unknown function called the SET (Suvar3–9, Enhancer-of-zeste, Trithorax) domain. We have demonstrated that SET domains mediate highly conserved interactions with a specific family of proteins that display similarity with dual-specificity phosphatases (dsPTPases). These include myotubularin, the gene of which is mutated in a subset of patients with X-linked myotubular myopathy, and Sbf1, a newly isolated homologue of myotubularin. In contrast with myotubularin, Sbf1 lacks a functional catalytic domain which dephosphorylates phospho-tyrosine and serine-containing peptides in vitro. Competitive interference of endogenous SET domain-dsPTPase interactions by forced expression of Sbf1 induced oncogenic transformation of NIH 3T3 fibroblasts and impaired the in vitro differentiation of C2 myoblast cells. We conclude that myotubularin-type phosphataees link SET-domain containing components of the epigenetic regulatory machinery with signalling pathways involved in growth and differentiation.

Firestein R, Cleary M L. Pseudo-phosphatase Sbf1 contains an N-terminal GEF homology domain that modulates its growth regulatory properties. J Cell Sci 2001 August;114 (Pt 16):2921–7

Sbf1 (SET binding factor 1) is a pseudo-phosphatase related to the myotubularin family of dual specificity phosphatases, some of which have been implicated in cellular growth and differentiation by virtue of their mutation in human genetic disorders. Sbf1 contains germline-encoded alterations of its myotubularin homology domain that render it non-functional as a phosphatase. We report here the complete structure of Sbf1 and further characterization of its growth regulatory properties. In addition to its similarity to myotubularin, the predicted full-length Sbf1 protein contains pleckstrin (PH) and GEF homology domains that are conserved in several proteins implicated in signaling and growth control. Forced expression of wild-type Sbf1 in NIH 3T3 cells inhibited their proliferation and altered their morphology. These effects required intact PH, GEF and myotubularin homology domains, implying that growth inhibition may be an intrinsic property of wild-type Sbf1. Conversely, deletion of its conserved N-terminal 44 amino acids alone was sufficient to convert Sbf1 from an inhibitor of cellular growth to a transforming protein in NIH 3T3 cells. Oncogenic forms of Sbf1 partially localized to the nucleus, in contrast to the exclusively cytoplasmic subcellular localization of endogenous Sbf1 in all cell lines and mammalian tissues tested. These data show that the N-terminal GEF homology domain serves to inhibit the transforming effects of Sbf1, possibly sequestering the protein to the cytoplasm, and suggest that this region may be a modulatory domain that relays growth control signals.

Panel 4.1D Summary: Ag4849 The NOV3a gene is expressed at high to moderate levels in a wide range of cell types of significance in the immune response in health and disease. These cells include members of the T-cell, B-cell, endothelial cell, macrophage/monocyte, and peripheral blood mononuclear cell family, as well as epithelial and fibroblast cell types from lung and skin, and normal tissues represented by colon, lung, thymus and kidney. This ubiquitous pattern of expression suggests that this gene product may be involved in homeostatic processes for these and other cell types and tissues. This pattern is in agreement with the expression profile in General_screening_panel_v1.5 and also suggests a role for the gene product in cell survival and proliferation. Therefore, modulation of the gene product with a functional therapeutic may lead to the alteration of functions associated with these cell types and lead to improvement of the symptoms of patients suffering from autoimmune and inflammatory diseases such as asthma, allergies, inflammatory bowel disease, lupus erythematosus, psoriasis, rheumatoid arthritis, and osteoarthritis.

NOV1a and NOV1c

Expression of gene NOV1a and variant NOV1c was assessed using the primer-probe sets Ag400, Ag2866 and Ag3077, described in Tables 20, 21 and 22. Results of the RTQ-PCR runs are shown in Tables 23, 24, 25, and 26.

TABLE 20

Probe Name Ag400

| Primers | Sequences | Length | Start Position | SEQ ID NO: |
|---|---|---|---|---|
| Forward | 5'-acgatcctgggctggacag-3' | 19 | 2684 | 155 |
| Probe | TET-5'-catctgcgcgtagcccctcca-3'-TAMRA | 21 | 2659 | 156 |
| Reverse | 5'-gcttcaaccccctcgagttc-3' | 20 | 2627 | 157 |

TABLE 21

Probe Name Ag2866

| Primers | Sequences | Length | Start Position | SEQ ID NO: |
|---|---|---|---|---|
| Forward | 5'-tatgtactcgtggtccctgaga-3' | 22 | 4075 | 158 |
| Probe | TET-5'-acgtctacagctttggctacctccgg-3'-TAMRA | 26 | 4097 | 159 |
| Reverse | 5'-agtggctgatgaagtcatagga-3' | 22 | 4141 | 160 |

TABLE 22

Probe Name Ag3077

| Primers | Sequences | Length | Start Position | SEQ ID NO: |
|---|---|---|---|---|
| Forward | 5'-aatgtggagctgtgcctgt-3' | 19 | 5431 | 161 |
| Probe | TET-5'-gactcatgccaggaatgtgcccc-3'-TAMRA | 23 | 5470 | 162 |
| Reverse | 5'-gaagagacctttgacgtccc-3' | 20 | 5504 | 163 |

TABLE 23

Panel 1

| Tissue Name | Rel. Exp. (%) Ag400, Run 91010053 | Rel. Exp. (%) Ag400, Run 97802926 | Tissue Name | Rel. Exp. (%) Ag400, Run 91010053 | Rel. Exp. (%) Ag400, Run 97802926 |
|---|---|---|---|---|---|
| Endothelial cells | 4.5 | 2.3 | Renal ca. 786-0 | 12.0 | 4.7 |
| Endothelial cells (treated) | 4.0 | 3.1 | Renal ca. A498 | 30.1 | 14.6 |
| Pancreas | 11.6 | 4.3 | Renal ca. RXF 393 | 13.2 | 5.1 |
| Pancreatic ca. CAPAN 2 | 18.8 | 11.3 | Renal ca. ACHN | 4.5 | 3.9 |
| Adrenal gland | 3.3 | 5.4 | Renal ca. UO-31 | 10.5 | 8.6 |
| Thyroid | 6.5 | 3.7 | Renal ca. TK-10 | 22.1 | 54.7 |
| Salivary gland | 3.3 | 2.3 | Liver | 4.8 | 5.1 |
| Pituitary gland | 5.8 | 8.4 | Liver (fetal) | 1.5 | 1.7 |
| Brain (fetal) | 1.5 | 1.9 | Liver ca. (hepatoblast) HepG2 | 13.8 | 23.0 |
| Brain (whole) | 8.7 | 4.2 | Lung | 24.3 | 8.4 |
| Brain (amygdala) | 1.1 | 2.6 | Lung (fetal) | 17.9 | 6.7 |
| Brain (cerebellum) | 100.0 | 16.3 | Lung ca. (small cell) LX-1 | 15.2 | 18.7 |
| Brain (hippocampus) | 2.3 | 2.5 | Lung ca. (small cell) NCI-H69 | 0.2 | 0.7 |
| Brain (substantia nigra) | 3.9 | 1.8 | Lung ca. (s. cell var.) SHP-77 | 14.9 | 2.3 |
| Brain (thalamus) | 3.0 | 5.0 | Lung ca. (large cell)NCI-H460 | 75.3 | 100.0 |
| Brain (hypothalamus) | 3.6 | 3.0 | Lung ca. (non-sm. cell) A549 | 40.6 | 28.3 |
| Spinal cord | 2.0 | 2.5 | Lung ca. (non-s. cell) NCI-H23 | 11.3 | 16.0 |

TABLE 23-continued

Panel 1

| Tissue Name | Rel. Exp. (%) Ag400, Run 91010053 | Rel. Exp. (%) Ag400, Run 97802926 | Tissue Name | Rel. Exp. (%) Ag400, Run 91010053 | Rel. Exp. (%) Ag400, Run 97802926 |
|---|---|---|---|---|---|
| glio/astro U87-MG | 0.2 | 0.6 | Lung ca. (non-s. cell) HOP-62 | 8.4 | 10.9 |
| glio/astro U-118-MG | 8.8 | 4.1 | Lung ca. (non-s. cl) NCI-H522 | 18.4 | 10.0 |
| astrocytoma SW1783 | 4.9 | 2.1 | Lung ca. (squam.) SW 900 | 46.7 | 28.3 |
| neuro*; met SK-N-AS | 11.1 | 21.9 | Lung ca. (squam.) NCI-H596 | 0.2 | 1.3 |
| astrocytoma SF-539 | 4.8 | 4.2 | Mammary gland | 26.8 | 25.5 |
| astrocytoma SNB-75 | 3.7 | 2.5 | Breast ca.* (pl. ef) MCF-7 | 23.0 | 13.3 |
| glioma SNB-19 | 46.0 | 51.1 | Breast ca.* (pl. ef) MDA-MB-231 | 9.3 | 7.5 |
| glioma U251 | 19.6 | 27.0 | Breast ca.* (pl. ef) T47D | 96.6 | 56.6 |
| glioma SF-295 | 8.9 | 16.4 | Breast ca. BT-549 | 12.1 | 4.2 |
| Heart | 7.9 | 11.9 | Breast ca. MDA-N | 0.0 | 0.1 |
| Skeletal muscle | 0.8 | 7.2 | Ovary | 9.2 | 4.9 |
| Bone marrow | 1.2 | 1.5 | Ovarian ca. OVCAR-3 | 30.6 | 43.5 |
| Thymus | 15.3 | 7.5 | Ovarian ca. OVCAR-4 | 50.3 | 22.5 |
| Spleen | 3.7 | 3.5 | Ovarian ca. OVCAR-5 | 39.8 | 34.2 |
| Lymph node | 6.7 | 2.1 | Ovarian ca. OVCAR-8 | 9.9 | 19.6 |
| Colon (ascending) | 5.9 | 1.2 | Ovarian ca. IGROV-1 | 63.3 | 70.2 |
| Stomach | 22.2 | 5.2 | Ovarian ca. (ascites) SK-OV-3 | 12.8 | 10.1 |
| Small intestine | 8.6 | 4.3 | Uterus | 13.8 | 13.8 |
| Colon ca. SW480 | 7.2 | 9.5 | Placenta | 38.4 | 28.9 |
| Colon ca.* SW620 (SW480 met) | 6.0 | 3.7 | Prostate | 16.5 | 10.4 |
| Colon ca. HT29 | 15.0 | 13.9 | Prostate ca.* (bone met) PC-3 | 71.7 | 87.7 |
| Colon ca. HCT-116 | 11.3 | 7.9 | Testis | 15.1 | 2.2 |
| Colon ca. CaCo-2 | 65.1 | 29.5 | Melanoma Hs688(A).T | 0.0 | 0.0 |
| Colon ca. HCT-15 | 12.1 | 9.2 | Melanoma* (met) Hs688(B).T | 0.3 | 0.3 |
| Colon ca. HCC-2998 | 12.1 | 18.6 | Melanoma UACC-62 | 0.5 | 4.7 |
| Gastric ca.* (liver met) NCI-N87 | 92.0 | 52.5 | Melanoma M14 | 3.8 | 1.3 |
| Bladder | 10.0 | 17.4 | Melanoma LOX IMVI | 0.0 | 0.0 |
| Trachea | 13.4 | 6.2 | Melanoma* (met) SK-MEL-5 | 2.3 | 2.9 |
| Kidney | 11.3 | 14.8 | Melanoma SK-MEL-28 | 2.4 | 0.0 |
| Kidney (fetal) | 19.1 | 16.6 | | | |

TABLE 24

Panel 1.3D

| Tissue Name | Rel. Exp. (%) Ag2866, Run 161974612 | Rel. Exp. (%) Ag3077, Run 165724514 | Tissue Name | Rel. Exp. (%) Ag2866, Run 161974612 | Rel. Exp. (%) Ag3077, Run 165724514 |
|---|---|---|---|---|---|
| Liver adenocarcinoma | 100.0 | 100.0 | Kidney (fetal) | 13.3 | 13.0 |
| Pancreas | 1.1 | 4.2 | Renal ca. 786-0 | 2.2 | 2.6 |
| Pancreatic ca. CAPAN 2 | 5.1 | 8.5 | Renal ca. A498 | 12.3 | 25.3 |
| Adrenal gland | 3.2 | 1.6 | Renal ca. RXF 393 | 7.2 | 25.9 |
| Thyroid | 4.7 | 6.5 | Renal ca. ACHN | 2.3 | 7.7 |
| Salivary gland | 0.7 | 3.3 | Renal ca. UO-31 | 2.4 | 4.4 |
| Pituitary gland | 1.5 | 4.2 | Renal ca. TK-10 | 5.9 | 8.6 |
| Brain (fetal) | 1.1 | 2.3 | Liver | 0.3 | 0.5 |
| Brain (whole) | 2.4 | 3.1 | Liver (fetal) | 0.7 | 1.9 |
| Brain (amygdala) | 1.3 | 3.3 | Liver ca. (hepatoblast) HepG2 | 4.9 | 9.4 |
| Brain (cerebellum) | 3.6 | 13.1 | Lung | 10.6 | 14.3 |
| Brain (hippocampus) | 2.5 | 3.4 | Lung (fetal) | 11.0 | 6.0 |
| Brain (substantia nigra) | 0.4 | 1.2 | Lung ca. (small cell) LX-1 | 5.6 | 9.2 |
| Brain (thalamus) | 2.0 | 4.2 | Lung ca. (small cell) NCI-H69 | 0.2 | 0.0 |
| Cerebral Cortex | 3.6 | 0.4 | Lung ca. (s. cell var.) SHP-77 | 3.9 | 1.8 |
| Spinal cord | 2.2 | 2.3 | Lung ca. (large cell)NCI-H460 | 19.9 | 89.5 |
| glio/astro U87-MG | 0.6 | 0.5 | Lung ca. (non-sm. cell) A549 | 8.4 | 10.0 |
| glio/astro U-118-MG | 4.5 | 22.8 | Lung ca. (non-s. cell) NCI-H23 | 6.4 | 3.8 |
| astrocytoma SW1783 | 10.7 | 4.5 | Lung ca. (non-s. cell) HOP-62 | 5.1 | 7.0 |
| neuro*; met SK-N-AS | 7.0 | 8.3 | Lung ca. (non-s. cl) NCI-H522 | 2.9 | 1.5 |
| astrocytoma SF-539 | 5.0 | 3.6 | Lung ca. (squam.) SW 900 | 7.0 | 18.9 |
| astrocytoma SNB-75 | 2.6 | 10.1 | Lung ca. (squam.) NCI-H596 | 0.3 | 0.1 |
| glioma SNB-19 | 27.4 | 20.6 | Mammary gland | 3.4 | 7.1 |
| glioma U251 | 14.6 | 46.0 | Breast ca.* (pl. ef) MCF-7 | 5.9 | 5.5 |
| glioma SF-295 | 6.7 | 6.0 | Breast ca.* (pl. ef) MDA-MB-231 | 6.5 | 20.4 |
| Heart (fetal) | 10.4 | 2.6 | Breast ca.* (pl. ef) T47D | 14.6 | 28.3 |
| Heart | 3.7 | 8.5 | Breast ca. BT-549 | 2.2 | 15.4 |
| Skeletal muscle (fetal) | 27.9 | 0.9 | Breast ca. MDA-N | 0.1 | 0.0 |
| Skeletal muscle | 1.7 | 1.0 | Ovary | 5.6 | 0.6 |
| Bone marrow | 0.5 | 0.5 | Ovarian ca. OVCAR-3 | 18.2 | 33.0 |
| Thymus | 5.1 | 2.7 | Ovarian ca. OVCAR-4 | 10.5 | 45.7 |
| Spleen | 4.6 | 4.0 | Ovarian ca. OVCAR-5 | 13.4 | 14.3 |
| Lymph node | 2.3 | 8.0 | Ovarian ca. OVCAR-8 | 5.2 | 3.0 |
| Colorectal | 5.4 | 0.6 | Ovarian ca. IGROV-1 | 17.4 | 22.1 |

TABLE 24-continued

Panel 1.3D

| Tissue Name | Rel. Exp. (%) Ag2866, Run 161974612 | Rel. Exp. (%) Ag3077, Run 165724514 | Tissue Name | Rel. Exp. (%) Ag2866, Run 161974612 | Rel. Exp. (%) Ag3077, Run 165724514 |
|---|---|---|---|---|---|
| Stomach | 2.9 | 6.4 | Ovarian ca.* (ascites) SK-OV-3 | 6.6 | 3.3 |
| Small intestine | 5.1 | 22.7 | Uterus | 3.4 | 16.2 |
| Colon ca. SW480 | 7.2 | 10.7 | Placenta | 12.5 | 44.4 |
| Colon ca.* SW620(SW480 met) | 2.5 | 3.0 | Prostate | 3.8 | 11.4 |
| Colon ca. HT29 | 8.5 | 2.9 | Prostate ca.* (bone met)PC-3 | 14.6 | 19.2 |
| Colon ca. HCT-116 | 3.6 | 3.5 | Testis | 1.2 | 3.6 |
| Colon ca. CaCo-2 | 27.5 | 22.5 | Melanoma Hs688(A).T | 0.0 | 0.0 |
| Colon ca. tissue(ODO3866) | 5.5 | 6.0 | Melanoma* (met) Hs688(B).T | 1.1 | 1.2 |
| Colon ca. HCC-2998 | 6.3 | 3.9 | Melanoma UACC-62 | 0.7 | 1.3 |
| Gastric ca.* (liver met) NCI-N87 | 28.5 | 47.3 | Melanoma M14 | 0.6 | 1.6 |
| Bladder | 9.3 | 2.9 | Melanoma LOX IMVI | 0.0 | 0.0 |
| Trachea | 8.2 | 11.7 | Melanoma* (met) SK-MEL-5 | 0.9 | 1.0 |
| Kidney | 7.2 | 7.2 | Adipose | 3.1 | 2.8 |

TABLE 25

Panel 2D

| Tissue Name | Rel. Exp. (%) Ag2866, Run 162011074 | Tissue Name | Rel. Exp. (%) Ag2866, Run 162011074 |
|---|---|---|---|
| Normal Colon | 41.5 | Kidney Margin 8120608 | 25.0 |
| CC Well to Mod Diff (ODO3866) | 13.9 | Kidney Cancer 8120613 | 28.7 |
| CC Margin (ODO3866) | 10.3 | Kidney Margin 8120614 | 27.5 |
| CC Gr.2 rectosigmoid (ODO3868) | 4.3 | Kidney Cancer 9010320 | 33.0 |
| CC Margin (ODO3868) | 11.6 | Kidney Margin 9010321 | 55.1 |
| CC Mod Diff (ODO3920) | 7.4 | Normal Uterus | 12.0 |
| CC Margin (ODO3920) | 26.2 | Uterus Cancer 064011 | 26.6 |
| CC Gr.2 ascend colon (ODO3921) | 14.3 | Normal Thyroid | 13.5 |
| CC Margin (ODO3921) | 11.4 | Thyroid Cancer 064010 | 22.5 |
| CC from Partial Hepatectomy (ODO4309) Mets | 21.9 | Thyroid Cancer A302152 | 22.2 |
| Liver Margin (ODO4309) | 8.2 | Thyroid Margin A302153 | 17.0 |
| Colon mets to lung (OD04451-01) | 8.8 | Normal Breast | 24.5 |
| Lung Margin (OD04451-02) | 17.2 | Breast Cancer (OD04566) | 15.9 |
| Normal Prostate 6546-1 | 11.9 | Breast Cancer (OD04590-01) | 87.1 |
| Prostate Cancer (OD04410) | 22.4 | Breast Cancer Mets (OD04590-03) | 100.0 |
| Prostate Margin (OD04410) | 26.4 | Breast Cancer Metastasis (OD04655-05) | 48.6 |
| Prostate Cancer (OD04720-01) | 32.3 | Breast Cancer 064006 | 28.9 |
| Prostate Margin | 30.6 | Breast Cancer 1024 | 42.9 |

TABLE 25-continued

Panel 2D

| Tissue Name | Rel. Exp. (%) Ag2866, Run 162011074 | Tissue Name | Rel. Exp. (%) Ag2866, Run 162011074 |
|---|---|---|---|
| (OD04720-02) | | | |
| Normal Lung 061010 | 32.8 | Breast Cancer 9100266 | 27.9 |
| Lung Met to Muscle (ODO4286) | 23.2 | Breast Margin 9100265 | 18.4 |
| Muscle Margin (ODO4286) | 25.3 | Breast Cancer A209073 | 20.0 |
| Lung Malignant Cancer (OD03126) | 22.8 | Breast Margin A2090734 | 18.2 |
| Lung Margin (OD03126) | 28.1 | Normal Liver | 3.8 |
| Lung Cancer (OD04404) | 23.8 | Liver Cancer 064003 | 1.9 |
| Lung Margin (OD04404) | 25.7 | Liver Cancer 1025 | 6.3 |
| Lung Cancer (OD04565) | 16.6 | Liver Cancer 1026 | 10.5 |
| Lung Margin (OD04565) | 16.3 | Liver Cancer 6004-T | 15.3 |
| Lung Cancer (OD04237-01) | 27.5 | Liver Tissue 6004-N | 9.0 |
| Lung Margin (OD04237-02) | 16.8 | Liver Cancer 6005-T | 13.4 |
| Ocular Mel Met to Liver (ODO4310) | 6.3 | Liver Tissue 6005-N | 1.7 |
| Liver Margin (ODO4310) | 3.6 | Normal Bladder | 26.1 |
| Melanoma Mets to Lung (OD04321) | 3.0 | Bladder Cancer 1023 | 6.6 |
| Lung Margin (OD04321) | 24.8 | Bladder Cancer A302173 | 12.2 |
| Normal Kidney | 32.1 | Bladder Cancer (OD04718-01) | 32.5 |
| Kidney Ca, Nuclear grade 2 (OD04338) | 46.7 | Bladder Normal Adjacent (OD04718-03) | 19.9 |
| Kidney Margin (OD04338) | 28.9 | Normal Ovary | 6.7 |
| Kidney Ca Nuclear grade 1/2 (OD04339) | 28.7 | Ovarian Cancer 064008 | 28.7 |
| Kidney Margin (OD04339) | 31.6 | Ovarian Cancer (OD04768-07) | 91.4 |
| Kidney Ca, Clear cell type (OD04340) | 50.7 | Ovary Margin (OD04768-08) | 13.6 |
| Kidney Margin (OD04340) | 47.6 | Normal Stomach | 25.0 |
| Kidney Ca, Nuclear grade 3 (OD04348) | 15.7 | Gastric Cancer 9060358 | 7.1 |
| Kidney Margin (OD04348) | 27.7 | Stomach Margin 9060359 | 6.3 |
| Kidney Cancer (OD04622-01) | 29.7 | Gastric Cancer 9060395 | 29.5 |
| Kidney Margin (OD04622-03) | 7.4 | Stomach Margin 9060394 | 14.6 |
| Kidney Cancer (OD04450-01) | 41.5 | Gastric Cancer 9060397 | 51.8 |
| Kidney Margin (OD04450-03) | 17.6 | Stomach Margin 9060396 | 3.6 |
| Kidney Cancer 8120607 | 23.5 | Gastric Cancer 064005 | 22.1 |

TABLE 26

Panel 4D

| Tissue Name | Rel. Exp. (%) Ag2866, Run 159616591 | Rel. Exp. (%) Ag3077, Run 164681476 | Tissue Name | Rel. Exp. (%) Ag2866, Run 159616591 | Rel. Exp. (%) Ag3077, Run 164681476 |
|---|---|---|---|---|---|
| Secondary Th1 act | 0.0 | 0.0 | HUVEC IL-1beta | 2.9 | 2.6 |
| Secondary Th2 act | 0.1 | 0.0 | HUVEC IFN gamma | 4.4 | 9.7 |
| Secondary Tr1 act | 0.1 | 0.3 | HUVEC TNF alpha + IFN gamma | 7.1 | 9.3 |

TABLE 26-continued

Panel 4D

| Tissue Name | Rel. Exp. (%) Ag2866, Run 159616591 | Rel. Exp. (%) Ag3077, Run 164681476 | Tissue Name | Rel. Exp. (%) Ag2866, Run 159616591 | Rel. Exp. (%) Ag3077, Run 164681476 |
|---|---|---|---|---|---|
| Secondary Th1 rest | 0.0 | 0.0 | HUVEC TNF alpha + IL4 | 4.3 | 11.3 |
| Secondary Th2 rest | 0.0 | 0.0 | HUVEC IL-11 | 3.7 | 3.8 |
| Secondary Tr1 rest | 0.1 | 0.0 | Lung Microvascular EC none | 10.2 | 15.5 |
| Primary Th1 act | 0.0 | 0.0 | Lung Microvascular EC TNFalpha + IL-1beta | 9.5 | 15.8 |
| Primary Th2 act | 0.1 | 0.0 | Microvascular Dermal EC none | 30.4 | 29.7 |
| Primary Tr1 act | 0.0 | 0.0 | Microsvasular Dermal EC TNFalpha + IL-1beta | 13.8 | 18.2 |
| Primary Th1 rest | 0.0 | 0.0 | Bronchial epithelium TNFalpha + IL1beta | 8.4 | 83.5 |
| Primary Th2 rest | 0.0 | 0.0 | Small airway epithelium none | 9.5 | 13.9 |
| Primary Tr1 rest | 0.1 | 0.0 | Small airway epithelium TNFalpha + IL-1beta | 33.9 | 21.3 |
| CD45RA CD4 lymphocyte act | 0.2 | 0.4 | Coronery artery SMC rest | 0.0 | 7.2 |
| CD45RO CD4 lymphocyte act | 0.0 | 0.0 | Coronery artery SMC TNFalpha + IL-1beta | 5.9 | 9.3 |
| CD8 lymphocyte act | 0.0 | 0.0 | Astrocytes rest | 28.1 | 38.4 |
| Secondary CD8 lymphocyte rest | 0.0 | 0.0 | Astrocytes TNFalpha + IL-1beta | 19.6 | 32.8 |
| Secondary CD8 lymphocyte act | 0.0 | 0.0 | KU-812 (Basophil) rest | 0.9 | 0.0 |
| CD4 lymphocyte none | 0.1 | 0.0 | KU-812 (Basophil) PMA/ionomycin | 1.3 | 1.8 |
| 2ry Th1/Th2/Tr1_anti-CD95 CH11 | 0.0 | 0.0 | CCD1106 (Keratinocytes) none | 10.6 | 21.5 |
| LAK cells rest | 0.2 | 0.0 | CCD1106 (Keratinocytes) TNFalpha + IL-1beta | 4.4 | 18.3 |
| LAK cells IL-2 | 0.0 | 0.2 | Liver cirrhosis | 2.9 | 2.2 |
| LAK cells IL-2 + IL-12 | 0.0 | 0.1 | Lupus kidney | 4.2 | 2.9 |
| LAK cells IL-2 + IFN gamma | 0.1 | 0.0 | NCI-H292 none | 71.2 | 55.1 |
| LAK cells IL-2 + IL-18 | 0.0 | 0.0 | NCI-H292 IL-4 | 91.4 | 67.8 |
| LAK cells PMA/ionomycin | 0.1 | 0.0 | NCI-H292 IL-9 | 100.0 | 75.8 |
| NK Cells IL-2 rest | 0.1 | 0.0 | NCI-H292 IL-13 | 80.7 | 100.0 |
| Two Way MLR 3 day | 0.1 | 0.3 | NCI-H292 IFN gamma | 68.8 | 95.9 |
| Two Way MLR 5 day | 0.1 | 0.0 | HPAEC none | 11.1 | 11.4 |
| Two Way MLR 7 day | 0.0 | 0.0 | HPAEC TNF alpha + IL-1beta | 9.2 | 15.6 |
| PBMC rest | 0.1 | 0.2 | Lung fibroblast none | 10.9 | 7.8 |
| PBMC PWM | 0.3 | 0.2 | Lung fibroblast TNFalpha + IL-1beta | 5.9 | 7.0 |
| PBMC PHA-L | 0.1 | 0.0 | Lung fibroblast IL-4 | 7.9 | 4.5 |
| Ramos (B cell) none | 1.8 | 1.5 | Lung fibroblast IL-9 | 9.2 | 5.3 |

TABLE 26-continued

Panel 4D

| Tissue Name | Rel. Exp. (%) Ag2866, Run 159616591 | Rel. Exp. (%) Ag3077, Run 164681476 | Tissue Name | Rel. Exp. (%) Ag2866, Run 159616591 | Rel. Exp. (%) Ag3077, Run 164681476 |
|---|---|---|---|---|---|
| Ramos (B cell) ionomycin | 3.7 | 3.0 | Lung fibroblast IL-13 | 6.6 | 5.1 |
| B lymphocytes PWM | 0.3 | 0.2 | Lung fibroblast IFN gamma | 5.2 | 4.2 |
| B lymphocytes CD40L and IL-4 | 1.9 | 0.9 | Dermal fibroblast CCD1070 rest | 1.9 | 0.5 |
| EOL-1 dbcAMP | 0.0 | 0.0 | Dermal fibroblast CCD1070 TNF alpha | 1.5 | 0.4 |
| EOL-1 dbcAMP PMA/ionomycin | 0.0 | 0.0 | Dermal fibroblast CCD1070 IL-1 beta | 0.8 | 1.2 |
| Dendritic cells none | 0.1 | 0.0 | Dermal fibroblast IFN gamma | 1.5 | 1.4 |
| Dendritic cells LPS | 0.1 | 0.0 | Dermal fibroblast IL-4 | 17.1 | 1.8 |
| Dendritic cells anti-CD40 | 0.1 | 0.0 | IBD Colitis 2 | 1.0 | 0.5 |
| Monocytes rest | 0.0 | 0.2 | IBD Crohn's | 0.8 | 0.9 |
| Monocytes LPS | 0.1 | 0.0 | Colon | 9.3 | 6.7 |
| Macrophages rest | 0.3 | 0.0 | Lung | 10.7 | 7.7 |
| Macrophages LPS | 0.3 | 0.5 | Thymus | 21.6 | 8.3 |
| HUVEC none | 8.9 | 7.2 | Kidney | 8.9 | 4.5 |
| HUVEC starved | 9.9 | 6.0 | | | |

Panel 1 Summary: Ag400 Two experiments with the same probe and primer produce results that are in very good agreement, with highest expression of the NOV1a gene in a lung cancer cell line and the brain. There are also significant levels of expression in clusters of cell lines derived from prostate, renal, ovarian, brain, and colon cancers. This suggests that expression of this gene may be associated with these cancers. Therefore, therapeutic modulation of this gene might be of use in the treatment of these cancers.

In addition, this gene, a laminin alpha 5 homolog, is expressed in several metabolic tissues including liver, pancreas and skeletal muscle. The gene also shows moderate to high levels of expression in several endocrine tissues including, pituitary, thyroid and testes, indicating an importance in general endocrine physiology. Thus, these levels of expression indicate that laminin alpha 5 may be involved in both endocrine and metabolic processes. Therapeutic modulation of this gene and/or gene product may therefore aid in the treatment of a number of endocrine disorders including metabolic disease.

This panel confirms the expression of this gene at moderate levels in all regions of the CNS examined. For a discussion of utility of this gene in the central nervous system, please see panel 1.3D.

Panel 1.3D Summary: Ag2866/3077 The expression of the NOV1a gene was assessed in two independent runs on this panel using two independent probes. There is reasonably good concordance between the runs with the highest expression in liver adenocarcinoma (CTs=24–28). There is also significant expression of this gene in prostate, renal, ovarian, lung, brain and colon cancer cell lines. This pattern is in agreement with the expression seen in Panel 1, with these data indicating that the expression of this gene might be associated with cancer of these tissues. Therefore, therapeutic modulation of this gene might be of use in the treatment of these cancers.

The gene, a laminin alpha 5 homolog, is also expressed in several metabolic tissues including adipose, liver, pancreas and skeletal muscle. The gene also has moderate to high levels of expression in several endocrine tissues as well, including pituitary, thyroid, and ovaries and testes. This expression profile suggests that this gene product may play a role in general endocrine physiology and be involved in both endocrine and metabolic processes. Therefore, therapeutic modulation of this gene and/or gene product may aid in the treatment of a number of endocrine disorders including metabolic disease.

In addition, this gene is expressed at moderate levels in all regions of the CNS examined. Laminin has been implicated in muscular dystrophy. Laminin alpha2 chain deficiency causes merosin-deficient congenital muscular dystrophy. Furthermore, laminin alpha 5 may be a functional component of the neuromuscular synapse. Therefore, therapeutic modulation of this gene may be of use in the treatment of muscular dystrophy.

REFERENCES

Nakagawa M, Miyagoe-Suzuki Y, Ikezoe K, Miyata Y, Nonaka I, Harii K, Takeda S. Schwann cell myelination occurred without basal lamina formation in laminin alpha2 chain-null mutant (dy3K/dy3K) mice. Glia 2001 August;35 (2):101–10.

The laminin alpha2 chain is a major component of basal lamina in both skeletal muscle and the peripheral nervous system. Laminin alpha2 chain deficiency causes merosin-deficient congenital muscular dystrophy, which affects not only skeletal muscles, but also the peripheral and central nervous systems. It has been reported that the formation of basal lamina is required for myelination in the peripheral nervous system. In fact, the spinal root of dystrophic mice (dy/dy mice), whose laminin alpha2 chain expression is greatly reduced, shows lack of basal lamina and clusters of naked axons. To investigate the role of laminin alpha2 chain and basal lamina in vivo, we examined the peripheral nervous system of dy3K/dy3K mice, which are null mutants of laminin alpha2 chain. The results indicate the presence of myelination although Schwann cells lacked basal lamina in the spinal roots of dy3K/dy3K mice, suggesting that basal lamina is not an absolute requirement for myelination in vivo. Immunohistochemically, the expression of laminin alpha4 chain was increased and laminin alpha5 chain was preserved in the endoneurium of the spinal root. Laminin alpha4 and alpha5 chains may play the critical role in myelination instead of laminin alpha2 chain in dy3K/dy3K mice. In addition, the motor conduction velocity of the sciatic nerve was significantly reduced compared with that of wild-type littermate. This reduction in conduction velocity may be due to small axon diameter, thin myelin sheath and the patchy disruption of the basal lamina of the nodes of Ranvierin dy3K/dy3K mice.

Son Y J, Scranton T W, Sunderland W J, Baek S J, Miner J H, Sanes J R, Carlson S S. The synaptic vesicle protein SV2 is complexed with an alpha5-containing laminin on the nerve terminal surface. J Biol Chem 2000 Jan. 7;275(1): 451–60

Interactions between growing axons and synaptic basal lamina components direct the formation of neuromuscular junctions during nerve regeneration. Isoforms of laminin containing alpha5 or beta2 chains are potential basal lamina ligands for these interactions. The nerve terminal receptors are unknown. Here we show that SV2, a synaptic vesicle transmembrane proteoglycan, is complexed with a 900-kDa laminin on synaptosomes from the electric organ synapse that is similar to the neuromuscular junctions. Although two laminins are present on synaptosomes, only the 900-kDa laminin is associated with SV2. Other nerve terminal components are absent from this complex. The 900-kDa laminin contains an alpha5, a beta1, and a novel gamma chain. To test whether SV2 directly binds the 900-kDa laminin, we looked for interaction between purified SV2 and laminin-I, a laminin isoform with a similar structure. We find SV2 binds with high affinity to purified laminin-1. Our results suggest that a synaptic vesicle component may act as a laminin receptor on the presynaptic plasma membrane; they also suggest a mechanism for activity-dependent adhesion at the synapse.

Panel 2.2 Summary: Ag3077 Data from one run with the NOV1a gene is not included because the amp plot indicates that there were experimental difficulties with this run.

Panel 2D Summary: Ag2866 The NOV1a gene is moderately expressed in all the tissues used in this panel. There is increased expression in stomach, breast and ovarian cancer samples compared to normal adjacent tissues from the same sample. Therefore, expression of this gene could potentially be used as a diagnostic marker for the presence of these cancers. Furthermore, therapeutic modulation of the activity of the gene product through the use of antibodies, small molecule inhibitors and chimeric molecules may be effective in the treatment of these cancers.

Panel 4D Summary: Ag2866/Ag3077 Two experiments with two different probe and primer sets produce results that are in very good agreement, with highest expression of the NOV1A gene in activated-NCI-H292 mucoepidermoid cells (CTs=24–28). Significant levels of expression are seen in IL-4, IL-9, IL-13 and IFN gamma activated-NC1—H292 mucoepidermoid cells as well as untreated NC1—H292 cells. Moderate/low expression is also detected in IL-4, IL-9, IL-13 and WFN gamma activated lung fibroblasts, human pulmonary aortic endothelial cells (treated and untreated), small airway epithelium (treated and untreated), treated bronchial epithelium and lung microvascular endothelial cells (treated and untreated). The expression of this gene in cells derived from or within the lung suggests that this gene may be involved in normal conditions as well as pathological and inflammatory lung disorders that include chronic obstructive pulmonary disease, asthma, allergy and emphysema. Moderate/low expression of NOV1A is also detected in treated and untreated HUVECs (endothelial cells), coronary artery smooth muscle cells (treated and untreated), treated and untreated astrocytes, treated KU-812 basophils, treated and untreated CCD1106 keratinocytes, IL-4 treated dermal fibroblasts, and normal tissues that include lung, colon, thymus and kidney. Low level expression is also detected in treated and untreated Ramos (B cell) cells as well as liver cirrhosis and lupus kidney samples. Expression in the various immune cell types (as well as in diseased tissue samples) suggests that therapeutic modulation of NOV1a may ameliorate symptoms associated with infectious conditions as well as inflammatory and autoimmune disorders that include psoriasis, allergy, asthma, inflammatory bowel disease, rheumatoid arthritis and osteoarthritis. Also, owing to the importance of immune cells/lymphoid cells (eg. T and B cells) in lupus and cirrhosis, therapeutic modulation of NOV1A may ameliorate symptoms associated with lupus and other autoimmune diseases as well as liver cirrhosis. NOV1a may also serve as a marker for these diseases.

NOV14b

Expression of gene NOV14b was assessed using the primer-probe set Ag2908, described in Table 27. Results of the RTQ-PCR runs are shown in Table 28.

TABLE 27

Probe Name Ag2908

| Primers | Sequences | Length | Start Position | SEQ ID NO: |
|---|---|---|---|---|
| Forward | 5'-attgtttacatcaaacggcatt-3' | 22 | 944 | 164 |
| Probe | TET-5'-aatcctttgaggcccttgtcccata-3'-TAMRA | 26 | 981 | 165 |
| Reverse | 5'-tcccagttgagactcctactga-3' | 22 | 1009 | 166 |

TABLE 28

Panel 4D

| Tissue Name | Rel. Exp. (%) Ag2908, Run 164403110 | Tissue Name | Rel. Exp. (%) Ag2908, Run 164403110 |
|---|---|---|---|
| Secondary Th1 act | 11.7 | HUVEC IL-1beta | 0.0 |
| Secondary Th2 act | 2.4 | HUVEC IFN gamma | 0.0 |

TABLE 28-continued

Panel 4D

| Tissue Name | Rel. Exp. (%) Ag2908, Run 164403110 | Tissue Name | Rel. Exp. (%) Ag2908, Run 164403110 |
|---|---|---|---|
| Secondary Tr1 act | 11.5 | HUVEC TNFalpha + IFN gamma | 0.0 |
| Secondary Th1 rest | 1.7 | HUVEC TNFalpha + IL4 | 0.0 |
| Secondary Th2 rest | 7.4 | HUVEC IL-11 | 0.0 |
| Secondary Tr1 rest | 6.0 | Lung Microvascular EC none | 0.0 |
| Primary Th1 act | 2.0 | Lung Microvascular EC TNFalpha + IL-1beta | 0.8 |
| Primary Th2 act | 5.6 | Microvascular Dermal EC none | 0.0 |
| Primary Tr1 act | 1.7 | Microsvasular Dermal EC TNFalpha + IL-1beta | 0.0 |
| Primary Th1 rest | 20.0 | Bronchial epithelium TNFalpha + 1beta | 0.0 |
| Primary Th2 rest | 13.8 | Small airway epithelium none | 0.0 |
| Primary Tr1 rest | 8.0 | Small airway epithelium TNFalpha + IL-1beta | 0.7 |
| CD45RA CD4 lymphocyte act | 0.8 | Coronery artery SMC rest | 0.0 |
| CD45RO CD4 lymphocyte act | 4.9 | Coronery artery SMC TNFalpha + IL-1beta | 0.0 |
| CD8 lymphocyte act | 0.0 | Astrocytes rest | 0.0 |
| Secondary CD8 lymphocyte rest | 0.8 | Astrocytes TNFalpha + IL-1beta | 0.0 |
| Secondary CD8 lymphocyte act | 4.2 | KU-812 (Basophil) rest | 0.0 |
| CD4 lymphocyte none | 0.0 | KU-812 (Basophil) PMA/ionomycin | 1.8 |
| 2ry Th1/Th2/Tr1_anti-CD95 CH11 | 13.1 | CCD1106 (Keratinocytes) none | 0.0 |
| LAK cells rest | 46.3 | CCD1106 (Keratinocytes) TNFalpha + IL-1beta | 0.0 |
| LAK cells IL-2 | 7.3 | Liver cirrhosis | 3.9 |
| LAK cells IL-2 + IL-12 | 3.3 | Lupus kidney | 1.3 |
| LAK cells IL-2 + IFN gamma | 11.3 | NCI-H292 none | 0.0 |
| LAK cells IL-2 + IL-18 | 6.2 | NCI-H292 IL-4 | 1.6 |
| LAK cells PMA/ionomycin | 11.5 | NCI-H292 IL-9 | 0.6 |
| NK Cells IL-2 rest | 15.1 | NCI-H292 IL-13 | 0.7 |
| Two Way MLR 3 day | 8.2 | NCI-H292 IFN gamma | 0.0 |
| Two Way MLR 5 day | 4.0 | HPAEC none | 0.0 |
| Two Way MLR 7 day | 2.5 | HPAEC TNFalpha + IL-1 beta | 0.0 |
| PBMC rest | 0.0 | Lung fibroblast none | 0.0 |
| PBMC PWM | 3.8 | Lung fibroblast TNFalpha + IL-1 beta | 0.0 |
| PBMC PHA-L | 5.5 | Lung fibroblast IL-4 | 0.0 |
| Ramos (B cell) none | 0.0 | Lung fibroblast IL-9 | 0.0 |
| Ramos (B cell) ionomycin | 0.0 | Lung fibroblast IL-13 | 0.0 |
| B lymphocytes PWM | 3.4 | Lung fibroblast IFN gamma | 0.0 |
| B lymphocytes CD40L and IL-4 | 1.5 | Dermal fibroblast CCD1070 rest | 0.0 |
| EOL-1 dbcAMP | 0.0 | Dermal fibroblast CCD1070 TNFalpha | 52.5 |
| EOL-1 dbcAMP PMA/ionomycin | 9.7 | Dermal fibroblast CCD1070 IL-1beta | 0.0 |
| Dendritic cells none | 94.0 | Dermal fibroblast IFN gamma | 0.0 |
| Dendritic cells LPS | 20.3 | Dermal fibroblast IL-4 | 0.0 |
| Dendritic cells anti-CD40 | 100.0 | IBD Colitis 2 | 0.9 |
| Monocytes rest | 23.2 | IBD Crohn's | 0.0 |
| Monocytes LPS | 0.0 | Colon | 0.0 |
| Macrophages rest | 54.7 | Lung | 0.7 |
| Macrophages LPS | 7.7 | Thymus | 0.9 |
| HUVEC none | 0.0 | Kidney | 0.0 |
| HUVEC starved | 0.0 | | |

CNS_neurodegeneration_v1.0 Summary: Ag2908 Expression of the NOV14b gene is low/undetectable in all samples on this panel. (CTs>35). (Data not shown.)

Panel 1.3D Summary: Ag2908 Expression of the NOV14b gene is restricted to bone marrow (CT=34.78). Thus, expression of this gene could be used as a marker for this tissue.

Panel 4D Summary: Ag2908 The NOV14b gene is expressed at low levels in resting lymphokine activated killer cells (LAK), resting macrophages and monocytes., and CCD1070 dermal fibroblasts treated with TNF alpha. Low level expression is also detected in both stimulated and resting dendritic cells. The expression of this gene in resting cells of these lineages suggests that the protein encoded by this transcript may be involved in normal immunological processes associated with immune homeostasis. Expression in TNFalpha treated dermal fibroblasts also suggests that this gene product may be involved in skin disorders, including psoriasis.

In addition, low level expression of this transcript is detected in stimulated lymphokine-activated killer cells (LAK). Since these cells are involved in tumor immunology and tumor cell clearance, as well as virally and bacterial infected cells, therapeutic modulation of this gene product may alter the functions of these cells and lead to improvement in cancer cell killing as well as host immunity to microbial and viral infections. This expression in immune cells suggests that therapeutic modulation of this gene product may ameliorate symptoms associated with inflammatory and autoimmune disorders that include psoriasis, allergy, asthma, inflammatory bowel disease, rheumatoid arthritis and osteoarthritis.

NOV11

Expression of gene NOV11 was assessed using the primer-probe sets Ag1522, Ag1848, Ag2263 and Ag2422, described in Tables 29, 30, 31and 32. Results of the RTQ-PCR runs are shown in Tables 33, 34, 35, 36, 37, 38, 39 and 40.

TABLE 29

Probe Name Ag1522

| Primers | Sequences | Length | Start Position | SEQ ID NO: |
|---|---|---|---|---|
| Forward | 5'-tgacttcgacacagacatcact-3' | 22 | 1242 | 167 |
| Probe | TET-5'-actcatctgctgccctgactggtg-3'-TAMRA | 24 | 1265 | 168 |
| Reverse | 5'-ccttgccgtcttaaagttgac-3' | 21 | 1300 | 169 |

TABLE 30

Probe Name Ag1848

| Primers | Sequences | Length | Start Position | SEQ ID NO: |
|---|---|---|---|---|
| Forward | 5'-tgacttcgacacagacatcact-3' | 22 | 1242 | 170 |
| Probe | TET-5'-actcatctgctgccctgactggtg-3'-TAMRA | 24 | 1265 | 171 |
| Reverse | 5'-ccttgccgtcttaaagttgac-3' | 21 | 1300 | 172 |

TABLE 31

Probe Name Ag2263

| Primers | Sequences | Length | Start Position | SEQ ID NO: |
|---|---|---|---|---|
| Forward | 5'-tgacttcgacacagacatcact-3' | 22 | 1242 | 173 |
| Probe | TET-5'-actcatctgctgccctgactggtg-3'-TAMRA | 24 | 1265 | 174 |
| Reverse | 5'-ccttgccgtcttaaagttgac-3' | 21 | 1300 | 175 |

TABLE 32

Probe Name Ag2422

| Primers | Sequences | Length | Start Position | SEQ ID NO: |
|---|---|---|---|---|
| Forward | 5'-ggctccctggacactctct-3' | 19 | 2530 | 176 |
| Probe | TET-5'-ctgtcaccacccagctgggaccttat-3'-TAMRA | 26 | 2567 | 177 |
| Reverse | 5'-tggacagtgggatcttgaag-3' | 20 | 2595 | 178 |

TABLE 33

AI_comprehensive_panel_v1.0

| Tissue Name | Rel. Exp. (%) Ag1522, Run 229393906 | Rel. Exp. (%) Ag1848, Run 229440541 | Tissue Name | Rel. Exp. (%) Ag1522, Run 229393906 | Rel. Exp. (%) Ag1848, Run 229440541 |
|---|---|---|---|---|---|
| 110967 COPD-F | 2.5 | 1.5 | 112427 Match Control Psoriasis-F | 13.0 | 6.9 |
| 110980 COPD-F | 5.6 | 5.4 | 112418 Psoriasis-M | 2.5 | 1.9 |
| 110968 COPD-M | 2.3 | 1.7 | 112723 Match Control Psoriasis-M | 3.3 | 3.0 |
| 110977 COPD-M | 12.2 | 10.0 | 112419 Psoriasis-M | 3.0 | 2.8 |
| 110989 Emphysema-F | 6.4 | 4.5 | 112424 Match Control Psoriasis-M | 2.5 | 1.7 |
| 110992 Emphysema-F | 4.2 | 2.6 | 112420 Psoriasis-M | 7.2 | 7.1 |
| 110993 Emphysema-F | 3.5 | 3.1 | 112425 Match Control Psoriasis-M | 5.5 | 6.7 |
| 110994 Emphysema-F | 2.8 | 1.3 | 104689 (MF) OA Bone-Backus | 100.0 | 92.7 |
| 110995 Emphysema-F | 10.0 | 3.8 | 104690 (MF) Adj "Normal" Bone-Backus | 32.1 | 35.1 |
| 110996 Emphysema-F | 2.1 | 0.9 | 104691 (MF) OA Synovium-Backus | 3.1 | 3.0 |
| 110997 Asthma-M | 3.5 | 1.1 | 104692 (BA) OA Cartilage-Backus | 27.9 | 22.1 |
| 111001 Asthma-F | 5.6 | 1.2 | 104694 (BA) OA Bone-Backus | 81.2 | 100.0 |
| 111002 Asthma-F | 6.7 | 3.4 | 104695 (BA) Adj "Normal" Bone-Backus | 57.0 | 54.7 |
| 111003 Atopic Asthma-F | 5.8 | 4.0 | 104696 (BA) OA Synovium-Backus | 14.4 | 11.9 |
| 111004 Atopic Asthma-F | 13.1 | 6.8 | 104700 (SS) OA Bone-Backus | 34.4 | 27.0 |
| 111005 Atopic Asthma-F | 5.2 | 3.3 | 104701 (SS) Adj "Normal" Bone-Backus | 44.1 | 45.7 |
| 111006 Atopic Asthma-F | 1.8 | 1.0 | 104702 (SS) OA Synovium-Backus | 5.3 | 4.9 |
| 111417 Allergy-M | 4.3 | 3.3 | 117093 OA Cartilage Rep7 | 3.4 | 3.0 |
| 112347 Allergy-M | 0.4 | 0.1 | 112672 OA Bone5 | 3.6 | 3.8 |
| 112349 Normal Lung-F | 0.3 | 0.1 | 112673 OA Synovium5 | 1.5 | 2.2 |
| 112357 Normal Lung-F | 2.6 | 3.0 | 112674 OA Synovial Fluid cells5 | 1.5 | 1.4 |
| 112354 Normal Lung-M | 1.1 | 1.3 | 117100 OA Cartilage Rep14 | 1.6 | 1.9 |
| 112374 Crohns-F | 9.7 | 5.7 | 112756 OA Bone9 | 7.3 | 5.7 |
| 112389 Match Control Crohns-F | 16.5 | 8.4 | 112757 OA Synovium9 | 0.8 | 0.5 |
| 112375 Crohns-F | 9.2 | 6.3 | 112758 OA Synovial Fluid Cells9 | 3.3 | 2.3 |
| 112732 Match Control Crohns-F | 2.7 | 2.5 | 117125 RA Cartilage Rep2 | 4.6 | 3.0 |
| 112725 Crohns-M | 0.8 | 0.6 | 113492 Bone2 RA | 6.5 | 5.3 |

TABLE 33-continued

AI_comprehensive_panel_v1.0

| Tissue Name | Rel. Exp. (%) Ag1522, Run 229393906 | Rel. Exp. (%) Ag1848, Run 229440541 | Tissue Name | Rel. Exp. (%) Ag1522, Run 229393906 | Rel. Exp. (%) Ag1848, Run 229440541 |
|---|---|---|---|---|---|
| 112387 Match Control Crohns-M | 6.3 | 4.5 | 113493 Synovium2 RA | 3.1 | 1.8 |
| 112378 Crohns-M | 0.5 | 0.2 | 113494 Syn Fluid Cells RA | 5.9 | 4.7 |
| 112390 Match Control Crohns-M | 23.7 | 16.7 | 113499 Cartilage4 RA | 5.2 | 3.4 |
| 112726 Crohns-M | 2.0 | 3.3 | 113500 Bone4 RA | 4.6 | 3.2 |
| 112731 Match Control Crohns-M | 4.8 | 3.4 | 113501 Synovium4 RA | 3.1 | 2.1 |
| 112380 Ulcer Col-F | 4.8 | 3.3 | 113502 Syn Fluid Cells4 RA | 2.7 | 2.2 |
| 112734 Match Control Ulcer Col-F | 7.4 | 3.8 | 113495 Cartilage3 RA | 4.4 | 3.1 |
| 112384 Ulcer Col-F | 6.7 | 5.6 | 113496 Bone3 RA | 5.0 | 3.0 |
| 112737 Match Control Ulcer Col-F | 1.7 | 0.9 | 113497 Synovium3 RA | 3.3 | 2.4 |
| 112386 Ulcer Col-F | 1.6 | 3.7 | 113498 Syn Fluid Cells3 RA | 6.2 | 4.0 |
| 112738 Match Control Ulcer Col-F | 1.4 | 1.0 | 117106 Normal Cartilage Rep20 | 3.1 | 3.0 |
| 112381 Ulcer Col-M | 0.2 | 0.1 | 113663 Bone3 Normal | 0.3 | 0.1 |
| 112735 Match Control Ulcer Col-M | 1.1 | 1.5 | 113664 Synovium3 Normal | 0.1 | 0.0 |
| 112382 Ulcer Col-M | 11.5 | 8.7 | 113665 Syn Fluid Cells3 Normal | 0.2 | 0.0 |
| 112394 Match Control Ulcer Col-M | 2.0 | 1.7 | 117107 Normal Cartilage Rep22 | 0.6 | 0.4 |
| 112383 Ulcer Col-M | 4.8 | 2.9 | 113667 Bone4 Normal | 0.7 | 0.7 |
| 112736 Match Control Ulcer Col-M | 22.2 | 6.3 | 113668 Synovium4 Normal | 0.8 | 0.7 |
| 112423 Psoriasis-F | 1.3 | 0.9 | 113669 Syn Fluid Cells4 Normal | 0.8 | 0.9 |

TABLE 34

CNS_neurodegeneration_v1.0

| Tissue Name | Rel. Exp. (%) Ag1848, Run 207776125 | Rel. Exp. (%) Ag2263, Run 219933384 | Rel. Exp. (%) Ag2263, Run 224115886 | Rel. Exp. (%) Ag2422, Run 206262709 | Rel. Exp. (%) Ag2422, Run 230512499 |
|---|---|---|---|---|---|
| AD 1 Hippo | 28.3 | 39.0 | 19.3 | 21.3 | 16.6 |
| AD 2 Hippo | 37.9 | 45.1 | 23.5 | 38.7 | 40.1 |
| AD 3 Hippo | 12.0 | 20.6 | 13.9 | 14.9 | 13.0 |
| AD 4 Hippo | 17.7 | 27.2 | 9.0 | 13.3 | 16.4 |
| AD 5 hippo | 45.4 | 60.3 | 8.1 | 57.8 | 59.0 |
| AD 6 Hippo | 66.9 | 96.6 | 70.2 | 95.9 | 66.0 |
| Control 2 Hippo | 43.2 | 81.2 | 67.8 | 46.0 | 48.3 |
| Control 4 Hippo | 34.2 | 36.6 | 38.7 | 30.4 | 27.5 |

TABLE 34-continued

CNS_neurodegeneration_v1.0

| Tissue Name | Rel. Exp. (%) Ag1848, Run 207776125 | Rel. Exp. (%) Ag2263, Run 219933384 | Rel. Exp. (%) Ag2263, Run 224115886 | Rel. Exp. (%) Ag2422, Run 206262709 | Rel. Exp. (%) Ag2422, Run 230512499 |
|---|---|---|---|---|---|
| Control (Path) 3 Hippo | 3.9 | 11.0 | 4.6 | 12.7 | 12.1 |
| AD 1 Temporal Ctx | 47.0 | 79.0 | 69.7 | 40.6 | 27.2 |
| AD 2 Temporal Ctx | 49.3 | 61.6 | 70.7 | 39.8 | 50.7 |
| AD 3 Temporal Ctx | 14.5 | 20.7 | 15.3 | 15.7 | 14.5 |
| AD 4 Temporal Ctx | 41.5 | 53.6 | 31.9 | 36.3 | 39.0 |
| AD 5 Inf Temporal Ctx | 77.9 | 95.9 | 72.2 | 88.9 | 100.0 |
| AD 5 SupTemporal Ctx | 40.9 | 57.4 | 3.7 | 57.0 | 69.3 |
| AD 6 Inf Temporal Ctx | 84.1 | 99.3 | 100.0 | 74.2 | 83.5 |
| AD 6 Sup Temporal Ctx | 58.2 | 64.6 | 81.8 | 71.7 | 61.1 |
| Control 1 Temporal Ctx | 17.9 | 18.0 | 21.5 | 11.3 | 16.5 |
| Control 2 Temporal Ctx | 45.7 | 39.8 | 66.4 | 44.8 | 55.1 |
| Control 3 Temporal Ctx | 14.7 | 21.8 | 22.7 | 15.6 | 13.5 |
| Control 4 Temporal Ctx | 23.2 | 21.5 | 23.8 | 19.1 | 24.1 |
| Control (Path) 1 Temporal Ctx | 46.0 | 39.8 | 19.3 | 40.3 | 51.1 |
| Control (Path) 2 Temporal Ctx | 24.7 | 40.6 | 23.7 | 21.8 | 24.0 |
| Control (Path) 3 Temporal Ctx | 6.0 | 8.2 | 8.0 | 7.7 | 7.3 |
| Control (Path) 4 Temporal Ctx | 32.1 | 29.5 | 31.0 | 24.0 | 18.6 |
| AD 1 Occipital Ctx | 24.1 | 48.0 | 5.5 | 26.4 | 13.7 |
| AD 2 Occipital Ctx (Missing) | 0.0 | 0.0 | 0.0 | 0.0 | 0.0 |
| AD 3 Occipital Ctx | 19.2 | 25.3 | 20.4 | 18.2 | 18.8 |
| AD 4 Occipital Ctx | 30.1 | 58.2 | 30.6 | 23.3 | 30.8 |
| AD 5 Occipital Ctx | 6.0 | 51.8 | 53.6 | 26.8 | 23.0 |
| AD 6 Occipital Ctx | 43.2 | 39.0 | 8.5 | 50.3 | 47.6 |
| Control 1 Occipital Ctx | 14.6 | 22.2 | 19.1 | 12.8 | 13.4 |
| Control 2 Occipital Ctx | 66.9 | 85.9 | 94.6 | 76.3 | 70.2 |
| Control 3 Occipital Ctx | 17.8 | 37.1 | 8.0 | 17.4 | 13.1 |
| Control 4 Occipital Ctx | 23.3 | 22.2 | 2.7 | 15.7 | 19.1 |
| Control (Path) 1 Occipital Ctx | 100.0 | 100.0 | 63.7 | 100.0 | 90.1 |
| Control (Path) 2 Occipital Ctx | 18.7 | 20.9 | 11.0 | 12.3 | 11.7 |
| Control (Path) 3 Occipital Ctx | 7.9 | 6.1 | 9.4 | 7.1 | 5.8 |
| Control (Path) 4 Occipital Ctx | 24.5 | 21.5 | 11.1 | 14.0 | 13.1 |
| Control 1 Parietal Ctx | 23.2 | 26.8 | 7.4 | 22.2 | 17.6 |
| Control 2 Parietal Ctx | 46.0 | 65.1 | 71.2 | 64.6 | 50.0 |
| Control 3 Parietal Ctx | 26.1 | 27.2 | 16.5 | 17.3 | 19.5 |
| Control (Path) 1 Parietal Ctx | 51.1 | 66.0 | 80.1 | 54.3 | 55.1 |
| Control (Path) 2 Parietal Ctx | 36.3 | 16.5 | 34.2 | 27.9 | 27.9 |

TABLE 34-continued

CNS_neurodegeneration_v1.0

| Tissue Name | Rel. Exp. (%) Ag1848, Run 207776125 | Rel. Exp. (%) Ag2263, Run 219933384 | Rel. Exp. (%) Ag2263, Run 224115886 | Rel. Exp. (%) Ag2422, Run 206262709 | Rel. Exp. (%) Ag2422, Run 230512499 |
|---|---|---|---|---|---|
| Control (Path) 3 Parietal Ctx | 6.1 | 10.5 | 1.4 | 5.1 | 4.6 |
| Control (Path) 4 Parietal Ctx | 46.0 | 52.5 | 10.7 | 36.6 | 12.2 |

TABLE 35

Panel 1.2

| Tissue Name | Rel. Exp. (%) Ag1522, Run 142131145 | Tissue Name | Rel. Exp. (%) Ag1522, Run 142131145 |
|---|---|---|---|
| Endothelial cells | 1.2 | Renal ca. 786-0 | 0.0 |
| Heart (Fetal) | 17.9 | Renal ca. A498 | 0.3 |
| Pancreas | 0.7 | Renal ca. RXF 393 | 0.2 |
| Pancreatic ca. CAPAN 2 | 4.9 | Renal ca. ACHN | 0.1 |
| Adrenal Gland | 7.9 | Renal ca. UO-31 | 0.5 |
| Thyroid | 0.1 | Renal ca. TK-10 | 0.3 |
| Salivary gland | 2.5 | Liver | 2.4 |
| Pituitary gland | 0.1 | Liver (fetal) | 0.5 |
| Brain (fetal) | 0.2 | Liver ca. (hepatoblast) HepG2 | 0.3 |
| Brain (whole) | 3.2 | Lung | 0.3 |
| Brain (amygdala) | 4.4 | Lung (fetal) | 0.4 |
| Brain (cerebellum) | 9.0 | Lung ca. (small cell) LX-1 | 25.3 |
| Brain (hippocampus) | 18.9 | Lung ca. (small cell) NCI-H69 | 43.8 |
| Brain (thalamus) | 15.7 | Lung ca. (s. cell var.) SHP-77 | 0.3 |
| Cerebral Cortex | 35.4 | Lung ca. (large cell)NCI-H460 | 54.7 |
| Spinal cord | 1.6 | Lung ca. (non-sm. cell) A549 | 0.3 |
| glio/astro U87-MG | 72.2 | Lung ca. (non-s. cell) NCI-H23 | 2.4 |
| glio/astro U-118-MG | 3.1 | Lung ca. (non-s. cell) HOP-62 | 1.7 |
| astrocytoma SW1783 | 0.3 | Lung ca. (non-s. cl) NCI-H522 | 9.3 |
| neuro*; met SK-N-AS | 36.3 | Lung ca. (squam.) SW 900 | 1.5 |
| astrocytoma SF-539 | 5.8 | Lung ca. (squam.) NCI-H596 | 22.4 |
| astrocytoma SNB-75 | 1.7 | Mammary gland | 1.4 |
| glioma SNB-19 | 23.8 | Breast ca.* (pl. ef) MCF-7 | 0.8 |
| glioma U251 | 2.9 | Breast ca.* (pl. ef) MDA-MB-231 | 0.1 |
| glioma SF-295 | 100.0 | Breast ca.* (pl. ef) T47D | 18.4 |
| Heart | 31.6 | Breast ca. BT-549 | 0.1 |
| Skeletal Muscle | 3.4 | Breast ca. MDA-N | 0.0 |
| Bone marrow | 0.2 | Ovary | 6.9 |
| Thymus | 0.2 | Ovarian ca. OVCAR-3 | 1.7 |
| Spleen | 2.1 | Ovarian ca. OVCAR-4 | 12.9 |
| Lymph node | 0.5 | Ovarian ca. OVCAR-5 | 5.7 |
| Colorectal Tissue | 1.4 | Ovarian ca. OVCAR-8 | 5.3 |
| Stomach | 1.3 | Ovarian ca. IGROV-1 | 0.8 |
| Small intestine | 3.3 | Ovarian ca. (ascites) SK-OV-3 | 5.4 |
| Colon ca. SW480 | 0.8 | Uterus | 0.9 |
| Colon ca.* SW620 (SW480 met) | 2.2 | Placenta | 0.9 |
| Colon ca. HT29 | 0.1 | Prostate | 10.0 |
| Colon ca. HCT-116 | 7.5 | Prostate ca.* (bone met) PC-3 | 0.1 |
| Colon ca. CaCo-2 | 6.3 | Testis | 0.3 |
| Colon ca. Tissue | 3.0 | Melanoma | 21.2 |

TABLE 35-continued

Panel 1.2

| Tissue Name | Rel. Exp. (%) Ag1522, Run 142131145 | Tissue Name | Rel. Exp. (%) Ag1522, Run 142131145 |
|---|---|---|---|
| (OD O3866) | | Hs688(A).T | |
| Colon ca. HCC-2998 | 1.2 | Melanoma* (met) Hs688(B).T | 28.5 |
| Gastric ca.* (liver met) NCI-N87 | 24.7 | Melanoma UACC-62 | 2.4 |
| Bladder | 12.8 | Melanoma M14 | 0.1 |
| Trachea | 0.3 | Melanoma LOX IMVI | 0.1 |
| Kidney | 19.2 | Melanoma* (met) SK-MEL-5 | 1.2 |
| Kidney (fetal) | 6.6 | | |

TABLE 36

Panel 1.3D

| Tissue Name | Rel. Exp. (%) Ag1522, Run 159601761 | Rel. Exp. (%) Ag1848, Run 160201402 | Rel. Exp. (%) Ag2263, Run 166011650 | Rel. Exp. (%) Ag2422, Run 159319549 |
|---|---|---|---|---|
| Liver adenocarcinoma | 15.8 | 12.3 | 31.4 | 18.3 |
| Pancreas | 1.7 | 1.4 | 2.8 | 2.9 |
| Pancreatic ca. CAPAN 2 | 6.7 | 4.6 | 21.6 | 5.5 |
| Adrenal gland | 3.9 | 2.0 | 3.5 | 3.0 |
| Thyroid | 1.7 | 1.5 | 0.0 | 2.5 |
| Salivary gland | 0.6 | 0.2 | 2.3 | 0.3 |
| Pituitary gland | 2.1 | 1.4 | 2.9 | 4.3 |
| Brain (fetal) | 1.4 | 1.1 | 3.5 | 1.1 |
| Brain (whole) | 28.7 | 13.5 | 43.2 | 10.4 |
| Brain (amygdala) | 16.8 | 13.0 | 31.2 | 18.6 |
| Brain (cerebellum) | 8.2 | 6.5 | 42.3 | 9.2 |
| Brain (hippocampus) | 60.7 | 47.6 | 16.8 | 51.8 |
| Brain (substantia nigra) | 8.9 | 5.2 | 32.3 | 6.8 |
| Brain (thalamus) | 40.1 | 22.2 | 62.0 | 19.8 |
| Cerebral Cortex | 25.9 | 18.4 | 36.6 | 14.3 |
| Spinal cord | 10.2 | 5.4 | 37.9 | 7.9 |
| glio/astro U87-MG | 43.2 | 34.6 | 100.0 | 48.6 |
| glio/astro U-118-MG | 10.2 | 8.0 | 6.4 | 7.5 |
| astrocytoma SW1783 | 0.9 | 0.8 | 2.8 | 1.1 |
| neuro*; met SK-N-AS | 100.0 | 100.0 | 59.0 | 100.0 |
| astrocytoma SF-539 | 9.7 | 8.3 | 17.7 | 9.0 |
| astrocytoma SNB-75 | 12.9 | 12.1 | 8.4 | 12.1 |
| glioma SNB-19 | 19.5 | 17.6 | 46.3 | 17.2 |
| glioma U251 | 13.4 | 10.6 | 24.5 | 10.9 |
| glioma SF-295 | 66.9 | 62.4 | 64.2 | 62.0 |
| Heart (fetal) | 15.6 | 12.5 | 20.0 | 18.7 |
| Heart | 2.2 | 1.1 | 3.4 | 3.3 |
| Skeletal muscle (fetal) | 22.2 | 14.0 | 6.7 | 19.3 |
| Skeletal muscle | 0.3 | 0.2 | 1.4 | 0.7 |
| Bone marrow | 0.7 | 0.3 | 0.4 | 0.8 |
| Thymus | 2.0 | 1.6 | 3.6 | 3.4 |
| Spleen | 7.9 | 5.6 | 4.5 | 5.9 |
| Lymph node | 2.6 | 1.9 | 2.7 | 2.1 |
| Colorectal | 4.7 | 9.2 | 12.8 | 10.3 |
| Stomach | 6.1 | 2.4 | 3.6 | 4.5 |
| Small intestine | 2.9 | 2.9 | 4.5 | 4.9 |
| Colon ca. SW480 | 2.0 | 1.0 | 1.9 | 1.5 |
| Colon ca.* SW620(SW480 met) | 1.0 | 1.2 | 2.0 | 2.1 |
| Colon ca. HT29 | 0.1 | 0.1 | 0.0 | 0.1 |
| Colon ca. HCT-116 | 4.2 | 2.9 | 4.7 | 5.6 |
| Colon ca. CaCo-2 | 5.3 | 3.9 | 12.5 | 7.2 |
| Colon ca. tissue(ODO3866) | 14.8 | 17.3 | 19.8 | 23.5 |

TABLE 36-continued

Panel 1.3D

| Tissue Name | Rel. Exp. (%) Ag1522, Run 159601761 | Rel. Exp. (%) Ag1848, Run 160201402 | Rel. Exp. (%) Ag2263, Run 166011650 | Rel. Exp. (%) Ag2422, Run 159319549 |
|---|---|---|---|---|
| Colon ca. HCC-2998 | 0.7 | 1.6 | 0.0 | 0.5 |
| Gastric ca.* (liver met) NCI-N87 | 21.9 | 22.8 | 19.1 | 25.7 |
| Bladder | 2.1 | 1.7 | 3.4 | 1.5 |
| Trachea | 12.2 | 6.8 | 1.6 | 13.8 |
| Kidney | 1.4 | 0.6 | 3.9 | 3.0 |
| Kidney (fetal) | 5.3 | 5.8 | 5.2 | 6.3 |
| Renal ca. 786-0 | 0.1 | 0.0 | 0.0 | 0.0 |
| Renal ca. A498 | 7.7 | 7.9 | 6.8 | 9.7 |
| Renal ca. RXF 393 | 0.1 | 3.6 | 0.8 | 0.1 |
| Renal ca. ACHN | 0.0 | 0.0 | 0.0 | 0.0 |
| Renal ca. UO-31 | 0.2 | 0.3 | 0.5 | 0.3 |
| Renal ca. TK-10 | 0.1 | 0.0 | 0.0 | 0.0 |
| Liver | 0.3 | 0.1 | 0.0 | 0.6 |
| Liver (fetal) | 1.1 | 1.0 | 0.3 | 1.2 |
| Liver ca. (hepatoblast) HepG2 | 0.2 | 0.0 | 0.8 | 0.3 |
| Lung | 8.2 | 9.4 | 4.1 | 10.3 |
| Lung (fetal) | 4.3 | 4.2 | 7.3 | 4.5 |
| Lung ca. (small cell) LX-1 | 8.4 | 6.9 | 31.6 | 9.9 |
| Lung ca. (small cell) NCI-H69 | 44.4 | 48.6 | 90.8 | 54.3 |
| Lung ca. (s.cell var.) SHP-77 | 0.7 | 0.8 | 0.5 | 1.1 |
| Lung ca. (large cell)NCI-H460 | 16.2 | 11.9 | 22.4 | 12.1 |
| Lung ca. (non-sm. cell) A549 | 0.4 | 0.3 | 0.2 | 0.4 |
| Lung ca. (non-s.cell) NCI-H23 | 2.0 | 0.9 | 3.3 | 1.2 |
| Lung ca. (non-s.cell) HOP-62 | 0.4 | 0.9 | 1.6 | 0.7 |
| Lung ca. (non-s.cl) NCI-H522 | 1.7 | 0.8 | 1.7 | 1.1 |
| Lung ca. (squam.) SW 900 | 0.5 | 0.3 | 1.9 | 0.2 |
| Lung ca. (squam.) NCI-H596 | 4.0 | 4.1 | 26.4 | 2.4 |
| Mammary gland | 6.3 | 4.4 | 3.0 | 2.8 |
| Breast ca.* (pl.ef) MCF-7 | 1.1 | 0.4 | 1.5 | 0.9 |
| Breast ca.* (pl.ef) MDA-MB-231 | 0.8 | 1.2 | 0.7 | 1.4 |
| Breast ca.* (pl.ef) T47D | 9.6 | 5.7 | 14.0 | 4.5 |
| Breast ca. BT-549 | 0.2 | 0.3 | 0.2 | 0.3 |
| Breast ca. MDA-N | 0.0 | 0.0 | 0.0 | 0.0 |
| Ovary | 6.4 | 4.9 | 6.2 | 9.5 |
| Ovarian ca. OVCAR-3 | 1.1 | 0.6 | 1.1 | 0.8 |
| Ovarian ca. OVCAR-4 | 1.0 | 1.4 | 11.4 | 1.5 |
| Ovarian ca. OVCAR-5 | 2.4 | 2.6 | 5.7 | 3.3 |
| Ovarian ca. OVCAR-8 | 3.6 | 1.6 | 2.6 | 5.4 |
| Ovarian ca. IGROV-1 | 0.6 | 0.2 | 0.7 | 0.2 |
| Ovarian ca.* (ascites) SK-OV-3 | 2.0 | 2.6 | 2.1 | 1.1 |
| Uterus | 2.7 | 1.3 | 3.9 | 4.2 |
| Placenta | 2.0 | 2.0 | 5.8 | 4.8 |
| Prostate | 4.4 | 2.5 | 3.4 | 5.4 |
| Prostate ca.* (bone met)PC-3 | 0.1 | 0.1 | 0.2 | 0.0 |
| Testis | 8.1 | 5.5 | 3.5 | 6.4 |
| Melanoma Hs688(A).T | 31.6 | 25.0 | 59.5 | 27.4 |
| Melanoma* (met) Hs688(B).T | 46.0 | 17.1 | 87.1 | 28.5 |
| Melanoma UACC-62 | 0.1 | 0.2 | 2.0 | 0.5 |
| Melanoma M14 | 0.0 | 0.0 | 0.0 | 0.0 |

TABLE 36-continued

Panel 1.3D

| Tissue Name | Rel. Exp. (%) Ag1522, Run 159601761 | Rel. Exp. (%) Ag1848, Run 160201402 | Rel. Exp. (%) Ag2263, Run 166011650 | Rel. Exp. (%) Ag2422, Run 159319549 |
|---|---|---|---|---|
| Melanoma LOX IMVI | 0.1 | 0.2 | 0.0 | 0.1 |
| Melanoma* (met) SK-MEL-5 | 0.9 | 0.9 | 1.7 | 0.6 |
| Adipose | 3.6 | 2.3 | 5.1 | 2.9 |

TABLE 37

Panel 2D

| Tissue Name | Rel. Exp. (%) Ag1522, Run 145049854 | Rel. Exp. (%) Ag1522, Run 145492337 | Rel. Exp. (%) Ag1848, Run 160202834 | Rel. Exp. (%) Ag2263, Run 165725935 | Rel. Exp. (%) Ag2422, Run 159317774 |
|---|---|---|---|---|---|
| Normal Colon | 20.2 | 46.0 | 35.1 | 59.0 | 36.9 |
| CC Well to Mod Diff (ODO3866) | 15.3 | 45.1 | 22.5 | 21.8 | 21.3 |
| CC Margin (ODO3866) | 6.1 | 15.2 | 7.4 | 7.7 | 5.5 |
| CC Gr.2 rectosigmoid (ODO3868) | 7.0 | 8.2 | 5.8 | 5.9 | 13.2 |
| CC Margin (ODO3868) | 0.3 | 0.5 | 0.5 | 9.3 | 0.8 |
| CC Mod Diff (ODO3920) | 1.2 | 4.0 | 2.5 | 5.6 | 5.8 |
| CC Margin (ODO3920) | 3.0 | 4.7 | 4.1 | 5.4 | 7.2 |
| CC Gr.2 ascend colon (ODO3921) | 10.7 | 22.5 | 24.1 | 19.9 | 25.5 |
| CC Margin (ODO3921) | 3.6 | 4.3 | 7.3 | 5.6 | 5.8 |
| CC from Partial Hepatectomy (ODO4309) Mets | 12.1 | 19.9 | 20.7 | 19.3 | 27.0 |
| Liver Margin (ODO4309) | 0.4 | 3.6 | 2.4 | 2.6 | 3.3 |
| Colon mets to lung (OD04451-01) | 5.8 | 11.9 | 6.1 | 8.5 | 10.7 |
| Lung Margin (OD04451-02) | 9.3 | 17.7 | 7.7 | 10.0 | 15.4 |
| Normal Prostate 6546-1 | 10.5 | 51.1 | 7.3 | 21.6 | 7.0 |
| Prostate Cancer (OD04410) | 12.2 | 14.9 | 14.9 | 9.0 | 17.4 |
| Prostate Margin (OD04410) | 14.6 | 13.8 | 25.3 | 19.2 | 29.7 |
| Prostate Cancer (OD04720-01) | 12.2 | 18.0 | 22.7 | 31.6 | 30.6 |
| Prostate Margin (OD04720-02) | 11.8 | 11.8 | 17.7 | 16.7 | 25.0 |
| Normal Lung 061010 | 7.3 | 17.8 | 17.6 | 12.8 | 22.4 |
| Lung Met to Muscle (ODO4286) | 12.7 | 27.4 | 25.0 | 31.0 | 22.1 |
| Muscle Margin (ODO4286) | 7.4 | 8.7 | 6.2 | 7.3 | 9.5 |
| Lung Malignant Cancer (OD03126) | 22.7 | 27.4 | 26.1 | 28.3 | 20.4 |
| Lung Margin (OD03126) | 12.7 | 21.9 | 21.9 | 13.9 | 31.9 |
| Lung Cancer (OD04404) | 17.9 | 41.5 | 41.5 | 30.4 | 48.0 |
| Lung Margin (OD04404) | 16.4 | 28.7 | 10.0 | 11.8 | 12.4 |

TABLE 37-continued

Panel 2D

| Tissue Name | Rel. Exp. (%) Ag1522, Run 145049854 | Rel. Exp. (%) Ag1522, Run 145492337 | Rel. Exp. (%) Ag1848, Run 160202834 | Rel. Exp. (%) Ag2263, Run 165725935 | Rel. Exp. (%) Ag2422, Run 159317774 |
|---|---|---|---|---|---|
| Lung Cancer (OD04565) | 22.5 | 38.2 | 28.5 | 27.9 | 40.6 |
| Lung Margin (OD04565) | 8.1 | 11.7 | 8.5 | 8.6 | 16.3 |
| Lung Cancer (OD04237-01) | 9.8 | 7.1 | 10.9 | 8.8 | 9.6 |
| Lung Margin (OD04237-02) | 12.9 | 23.0 | 14.3 | 14.0 | 16.0 |
| Ocular Mel Met to Liver (ODO4310) | 0.6 | 0.5 | 0.7 | 0.5 | 1.1 |
| Liver Margin (ODO4310) | 3.5 | 2.6 | 1.8 | 3.3 | 3.0 |
| Melanoma Mets to Lung (OD04321) | 1.4 | 2.0 | 3.6 | 4.3 | 2.9 |
| Lung Margin (OD04321) | 20.4 | 14.4 | 25.2 | 24.0 | 18.6 |
| Normal Kidney | 20.2 | 19.9 | 18.0 | 17.4 | 26.1 |
| Kidney Ca, Nuclear grade 2 (OD04338) | 1.7 | 4.2 | 2.9 | 2.7 | 4.9 |
| Kidney Margin (OD04338) | 6.2 | 11.7 | 17.2 | 11.3 | 22.8 |
| Kidney Ca Nuclear grade 1/2 (OD04339) | 3.6 | 10.0 | 3.7 | 4.6 | 6.6 |
| Kidney Margin (OD04339) | 11.7 | 12.2 | 11.4 | 12.1 | 11.0 |
| Kidney Ca, Clear cell type (OD04340) | 46.7 | 50.7 | 66.0 | 65.1 | 70.7 |
| Kidney Margin (OD04340) | 15.3 | 19.1 | 14.8 | 12.9 | 16.8 |
| Kidney Ca, Nuclear grade 3 (OD04348) | 21.0 | 9.5 | 16.3 | 16.8 | 17.0 |
| Kidney Margin (OD04348) | 8.2 | 5.8 | 8.8 | 11.5 | 9.3 |
| Kidney Cancer (OD04622-01) | 24.0 | 25.3 | 27.7 | 24.8 | 41.5 |
| Kidney Margin (OD04622-03) | 2.1 | 4.6 | 3.4 | 3.1 | 5.9 |
| Kidney Cancer (OD04450-01) | 0.2 | 0.0 | 0.2 | 0.5 | 0.5 |
| Kidney Margin (OD04450-03) | 5.9 | 6.3 | 9.3 | 9.9 | 12.9 |
| Kidney Cancer 8120607 | 7.3 | 9.1 | 11.9 | 12.8 | 13.4 |
| Kidney Margin 8120608 | 12.2 | 6.2 | 7.9 | 5.6 | 8.0 |
| Kidney Cancer 8120613 | 3.6 | 8.0 | 5.2 | 8.8 | 10.1 |
| Kidney Margin 8120614 | 6.3 | 6.7 | 8.9 | 7.5 | 9.3 |
| Kidney Cancer 9010320 | 18.7 | 61.1 | 25.0 | 21.9 | 22.1 |
| Kidney Margin 9010321 | 14.0 | 20.3 | 16.4 | 12.9 | 17.9 |
| Normal Uterus | 4.1 | 5.6 | 3.3 | 8.4 | 6.0 |
| Uterus Cancer 064011 | 9.6 | 10.7 | 17.1 | 11.7 | 15.6 |
| Normal Thyroid | 2.6 | 9.2 | 2.6 | 1.5 | 3.6 |
| Thyroid Cancer 064010 | 100.0 | 72.7 | 100.0 | 82.9 | 100.0 |
| Thyroid Cancer A302152 | 7.6 | 4.5 | 12.5 | 8.0 | 11.7 |
| Thyroid Margin A302153 | 3.0 | 2.4 | 2.8 | 3.2 | 6.0 |
| Normal Breast | 10.3 | 5.7 | 9.9 | 12.9 | 7.2 |
| Breast Cancer (OD04566) | 11.7 | 15.9 | 12.8 | 12.9 | 12.8 |

TABLE 37-continued

Panel 2D

| Tissue Name | Rel. Exp. (%) Ag1522, Run 145049854 | Rel. Exp. (%) Ag1522, Run 145492337 | Rel. Exp. (%) Ag1848, Run 160202834 | Rel. Exp. (%) Ag2263, Run 165725935 | Rel. Exp. (%) Ag2422, Run 159317774 |
|---|---|---|---|---|---|
| Breast Cancer (OD04590-01) | 17.9 | 39.0 | 27.2 | 16.5 | 25.3 |
| Breast Cancer Mets (OD04590-03) | 26.1 | 66.0 | 35.4 | 42.0 | 27.9 |
| Breast Cancer Metastasis (OD04655-05) | 4.5 | 5.4 | 6.0 | 5.2 | 3.5 |
| Breast Cancer 064006 | 30.8 | 32.1 | 28.1 | 21.6 | 36.3 |
| Breast Cancer 1024 | 20.7 | 46.7 | 19.8 | 16.7 | 14.8 |
| Breast Cancer 9100266 | 13.1 | 15.9 | 13.9 | 11.0 | 22.1 |
| Breast Margin 9100265 | 10.4 | 14.4 | 15.6 | 16.4 | 20.9 |
| Breast Cancer A209073 | 22.2 | 26.8 | 34.2 | 25.5 | 50.0 |
| Breast Margin A2090734 | 6.7 | 9.7 | 7.1 | 4.3 | 11.3 |
| Normal Liver | 1.4 | 4.2 | 1.6 | 1.7 | 2.3 |
| Liver Cancer 064003 | 1.0 | 2.8 | 1.7 | 1.3 | 1.3 |
| Liver Cancer 1025 | 1.4 | 1.1 | 3.3 | 2.3 | 3.2 |
| Liver Cancer 1026 | 7.8 | 6.5 | 4.9 | 6.4 | 10.7 |
| Liver Cancer 6004-T | 5.0 | 9.9 | 4.2 | 3.0 | 5.2 |
| Liver Tissue 6004-N | 4.7 | 7.9 | 3.5 | 4.2 | 3.7 |
| Liver Cancer 6005-T | 7.9 | 11.5 | 8.2 | 10.3 | 6.7 |
| Liver Tissue 6005-N | 2.0 | 3.2 | 2.7 | 1.6 | 2.3 |
| Normal Bladder | 6.8 | 17.9 | 13.6 | 11.5 | 15.2 |
| Bladder Cancer 1023 | 10.7 | 22.8 | 14.5 | 14.2 | 14.2 |
| Bladder Cancer A302173 | 18.0 | 29.3 | 22.7 | 17.7 | 23.5 |
| Bladder Cancer (OD04718-01) | 14.5 | 29.3 | 26.1 | 21.0 | 28.3 |
| Bladder Normal Adjacent (OD04718-03) | 2.9 | 5.0 | 3.1 | 3.2 | 4.2 |
| Normal Ovary | 1.4 | 4.7 | 3.6 | 4.6 | 5.4 |
| Ovarian Cancer 064008 | 40.9 | 100.0 | 89.5 | 100.0 | 76.3 |
| Ovarian Cancer (OD04768-07) | 9.7 | 43.2 | 16.7 | 15.6 | 19.5 |
| Ovary Margin (OD04768-08) | 6.5 | 7.9 | 10.8 | 6.7 | 8.3 |
| Normal Stomach | 11.8 | 39.5 | 14.7 | 14.8 | 13.1 |
| Gastric Cancer 9060358 | 1.4 | 6.0 | 2.9 | 2.8 | 2.9 |
| Stomach Margin 9060359 | 6.4 | 19.9 | 7.4 | 10.8 | 8.7 |
| Gastric Cancer 9060395 | 11.1 | 58.6 | 21.6 | 21.2 | 32.3 |
| Stomach Margin 9060394 | 6.8 | 34.6 | 23.7 | 13.8 | 22.2 |
| Gastric Cancer 9060397 | 15.4 | 78.5 | 24.8 | 25.2 | 31.9 |
| Stomach Margin 9060396 | 3.9 | 14.5 | 6.1 | 7.5 | 7.9 |
| Gastric Cancer 064005 | 2.5 | 14.8 | 7.0 | 7.3 | 13.0 |

TABLE 38

Panel 3D

| Tissue Name | Rel. Exp. (%) Ag2263, Run 170189128 | Tissue Name | Rel. Exp. (%) Ag2263, Run 170189128 |
|---|---|---|---|
| Daoy-Medulloblastoma | 19.1 | Ca Ski- Cervical epidermoid carcinoma (metastasis) | 0.4 |
| TE671-Medulloblastoma | 8.4 | ES-2-Ovarian clear cell carcinoma | 0.0 |
| D283 Med-Medulloblastoma | 39.2 | Ramos-Stimulated with PMA/ionomycin 6 h | 0.0 |
| PFSK-1-Primitive Neuroectodermal | 59.5 | Ramos-Stimulated with PMA/ionomycin 14 h | 0.0 |
| XF-498-CNS | 0.9 | MEG-01-Chronic myelogenous leukemia (megokaryoblast) | 3.8 |
| SNB-78-Glioma | 35.4 | Raji-Burkitt's lymphoma | 0.0 |
| SF-268-Glioblastoma | 0.0 | Daudi-Burkitt's lymphoma | 0.0 |
| T98G-Glioblastoma | 1.2 | U266-B-cell plasmacytoma | 0.0 |
| SK-N-SH-Neuroblastoma (metastasis) | 94.6 | CA46-Burkitt's lymphoma | 0.0 |
| SF-295-Glioblastoma | 0.3 | RL-non-Hodgkin's B-cell lymphoma | 0.0 |
| Cerebellum | 37.4 | JM1-pre-B-cell lymphoma | 0.0 |
| Cerebellum | 35.1 | Jurkat-T cell leukemia | 0.5 |
| NCI-H292-Mucoepidermoid lung carcinoma | 4.3 | TF-1-Erythroleukemia | 73.2 |
| DMS-114-Small cell lung cancer | 6.6 | HUT 78-T-cell lymphoma | 0.0 |
| DMS-79-Small cell lung cancer | 100.0 | U937-Histiocytic lymphoma | 0.0 |
| NCI-H146-Small cell lung cancer | 37.4 | KU-812-Myelogenous leukemia | 0.6 |
| NCI-H526-Small cell lung cancer | 17.2 | 769-P-Clear cell renal carcinoma | 0.0 |
| NCI-N417-Small cell lung cancer | 88.9 | Caki-2-Clear cell renal carcinoma | 0.0 |
| NCI-H82-Small cell lung cancer | 95.3 | SW 839-Clear cell renal carcinoma | 0.0 |
| NCI-H157-Squamous cell lung cancer (metastasis) | 0.8 | G401-Wilms' tumor | 2.8 |
| NCI-H1155-Large cell lung cancer | 55.5 | Hs766T-Pancreatic carcinoma (LN metastasis) | 0.6 |
| NCI-H1299-Large cell lung cancer | 0.0 | CAPAN-1-Pancreatic adenocarcinoma (liver metastasis) | 3.1 |
| NCI-H727-Lung carcinoid | 0.7 | SU86.86-Pancreatic carcinoma (liver metastasis) | 0.4 |
| NCI-UMC-11-Lung carcinoid | 7.9 | BxPC-3-Pancreatic adenocarcinoma | 22.8 |
| LX-1-Small cell lung cancer | 1.8 | HPAC-Pancreatic adenocarcinoma | 35.6 |
| Colo-205-Colon cancer | 0.3 | MIA PaCa-2-Pancreatic carcinoma | 0.6 |
| KM12-Colon cancer | 0.1 | CFPAC-1-Pancreatic ductal adenocarcinoma | 1.1 |
| KM20L2-Colon cancer | 0.6 | PANC-1-Pancreatic epithelioid ductal carcinoma | 0.3 |
| NCI-H716-Colon cancer | 70.2 | T24-Bladder carcinma (transitional cell) | 0.0 |
| SW-48-Colon adenocarcinoma | 0.0 | 5637-Bladder carcinoma | 2.2 |
| SW1116-Colon adenocarcinoma | 16.6 | HT-1197-Bladder carcinoma | 0.4 |
| LS 174T-Colon adenocarcinoma | 4.2 | UM-UC-3-Bladder carcinma (transitional cell) | 0.2 |
| SW-948-Colon adenocarcinoma | 0.4 | A204-Rhabdomyosarcoma | 0.0 |
| SW-480-Colon adenocarcinoma | 0.0 | HT-1080-Fibrosarcoma | 7.9 |
| NCI-SNU-5-Gastric carcinoma | 1.7 | MG-63-Osteosarcoma | 16.3 |
| KATO III-Gastric carcinoma | 17.4 | SK-LMS-1-Leiomyosarcoma (vulva) | 0.0 |

TABLE 38-continued

Panel 3D

| Tissue Name | Rel. Exp. (%) Ag2263, Run 170189128 | Tissue Name | Rel. Exp. (%) Ag2263, Run 170189128 |
|---|---|---|---|
| NCI-SNU-16-Gastric carcinoma | 0.7 | SJRH30-Rhabdomyosarcoma (met to bone marrow) | 3.9 |
| NCI-SNU-1-Gastric carcinoma | 23.0 | A431-Epidermoid carcinoma | 34.9 |
| RF-1-Gastric adenocarcinoma | 0.0 | WM266-4-Melanoma | 0.0 |
| RF-48-Gastric adenocarcinoma | 0.0 | DU 145-Prostate carcinoma (brain metastasis) | 0.0 |
| MKN-45-Gastric carcinoma | 11.5 | MDA-MB-468-Breast adenocarcinoma | 16.4 |
| NCI-N87-Gastric carcinoma | 24.0 | SCC-4-Squamous cell carcinoma of tongue | 0.0 |
| OVCAR-5-Ovarian carcinoma | 3.7 | SCC-9-Squamous cell carcinoma of tongue | 0.0 |
| RL95-2-Uterine carcinoma | 4.6 | SCC-15-Squamous cell carcinoma of tongue | 0.0 |
| HelaS3-Cervical adenocarcinoma | 5.9 | CAL 27-Squamous cell carcinoma of tongue | 7.1 |

TABLE 39

Panel 4D

| Tissue Name | Rel. Exp. (%) Ag1522, Run 145789191 | Rel. Exp. (%) Ag1848, Run 160202841 | Rel. Exp. (%) Ag2263, Run 151562852 | Rel. Exp. (%) Ag2422, Run 159318890 |
|---|---|---|---|---|
| Secondary Th1 act | 0.0 | 0.1 | 0.0 | 0.2 |
| Secondary Th2 act | 0.0 | 0.0 | 0.0 | 0.0 |
| Secondary Tr1 act | 0.0 | 0.0 | 0.0 | 4.6 |
| Secondary Th1 rest | 0.1 | 0.0 | 0.1 | 0.0 |
| Secondary Th2 rest | 0.0 | 0.0 | 0.0 | 0.0 |
| Secondary Tr1 rest | 0.0 | 0.0 | 0.0 | 0.2 |
| Primary Th1 act | 0.1 | 0.2 | 0.2 | 1.0 |
| Primary Th2 act | 0.1 | 0.2 | 0.1 | 0.3 |
| Primary Tr1 act | 0.2 | 0.5 | 0.0 | 0.6 |
| Primary Th1 rest | 0.0 | 0.0 | 0.0 | 0.0 |
| Primary Th2 rest | 0.0 | 0.0 | 0.0 | 0.0 |
| Primary Tr1 rest | 0.0 | 0.0 | 0.0 | 0.0 |
| CD45RA CD4 lymphocyte act | 4.9 | 6.3 | 8.5 | 10.6 |
| CD45RO CD4 lymphocyte act | 0.0 | 0.0 | 0.0 | 0.0 |
| CD8 lymphocyte act | 0.0 | 0.0 | 0.0 | 0.0 |
| Secondary CD8 lymphocyte rest | 0.0 | 0.0 | 0.0 | 0.0 |
| Secondary CD8 lymphocyte act | 0.0 | 0.0 | 0.0 | 0.0 |
| CD4 lymphocyte none | 0.0 | 0.0 | 0.0 | 0.0 |
| 2ry Th1/Th2/Tr1_anti-CD95 CH11 | 0.0 | 0.0 | 0.0 | 0.0 |
| LAK cells rest | 1.8 | 2.7 | 2.0 | 5.8 |
| LAK cells IL-2 | 0.0 | 0.0 | 0.0 | 0.0 |
| LAK cells IL-2 + IL-12 | 0.0 | 0.1 | 0.0 | 0.2 |
| LAK cells IL-2 + IFN gamma | 0.0 | 0.1 | 0.0 | 0.2 |
| LAK cells IL-2 + IL-18 | 0.0 | 0.4 | 0.0 | 0.1 |
| LAK cells PMA/ionomycin | 1.1 | 1.0 | 1.7 | 2.5 |
| NK Cells IL-2 rest | 0.0 | 0.1 | 0.0 | 0.0 |
| Two Way MLR 3 day | 0.0 | 0.1 | 0.2 | 0.2 |
| Two Way MLR 5 day | 0.2 | 0.3 | 0.8 | 0.6 |
| Two Way MLR 7 day | 0.5 | 0.2 | 0.1 | 0.3 |
| PBMC rest | 0.0 | 0.0 | 0.1 | 0.0 |
| PBMC PWM | 0.0 | 0.1 | 0.0 | 0.0 |
| PBMC PHA-L | 0.0 | 0.1 | 0.0 | 0.0 |
| Ramos (B cell) none | 0.0 | 0.0 | 0.0 | 0.0 |
| Ramos (B cell) ionomycin | 0.0 | 0.0 | 0.0 | 0.0 |
| B lymphocytes PWM | 0.2 | 0.0 | 0.0 | 0.0 |

TABLE 39-continued

Panel 4D

| Tissue Name | Rel. Exp. (%) Ag1522, Run 145789191 | Rel. Exp. (%) Ag1848, Run 160202841 | Rel. Exp. (%) Ag2263, Run 151562852 | Rel. Exp. (%) Ag2422, Run 159318890 |
|---|---|---|---|---|
| B lymphocytes CD40L and IL-4 | 0.0 | 0.1 | 0.1 | 0.3 |
| EOL-1 dbcAMP | 0.2 | 0.2 | 0.4 | 0.0 |
| EOL-1 dbcAMP PMA/ionomycin | 0.1 | 0.4 | 0.2 | 0.6 |
| Dendritic cells none | 1.4 | 1.1 | 1.0 | 2.8 |
| Dendritic cells LPS | 0.3 | 0.4 | 0.3 | 0.4 |
| Dendritic cells anti-CD40 | 2.4 | 3.0 | 3.5 | 6.7 |
| Monocytes rest | 0.8 | 0.8 | 0.6 | 1.3 |
| Monocytes LPS | 0.0 | 0.0 | 0.3 | 0.0 |
| Macrophages rest | 1.3 | 1.0 | 0.0 | 2.0 |
| Macrophages LPS | 0.0 | 0.2 | 0.1 | 0.4 |
| HUVEC none | 1.1 | 1.4 | 0.6 | 2.5 |
| HUVEC starved | 4.4 | 4.7 | 2.9 | 6.0 |
| HUVEC IL-1beta | 1.7 | 2.8 | 1.0 | 2.3 |
| HUVEC IFN gamma | 1.6 | 1.4 | 2.5 | 1.9 |
| HUVEC TNFalpha + IFN gamma | 0.3 | 0.3 | 0.5 | 0.5 |
| HUVEC TNFalpha + IL4 | 0.2 | 0.3 | 0.3 | 1.3 |
| HUVEC IL-11 | 0.9 | 1.2 | 2.2 | 0.5 |
| Lung Microvascular EC none | 2.2 | 6.5 | 2.8 | 6.7 |
| Lung Microvascular EC TNFalpha + IL-1beta | 12.7 | 11.9 | 8.5 | 15.5 |
| Microvascular Dermal EC none | 32.1 | 30.8 | 22.4 | 22.4 |
| Microsvasular Dermal EC TNFalpha + IL-1beta | 16.3 | 16.2 | 8.8 | 14.4 |
| Bronchial epithelium TNFalpha + IL1beta | 24.0 | 31.2 | 15.1 | 50.7 |
| Small airway epithelium none | 8.8 | 5.9 | 6.7 | 12.8 |
| Small airway epithelium TNFalpha + IL-1beta | 31.9 | 43.5 | 21.0 | 44.8 |
| Coronery artery SMC rest | 27.4 | 28.7 | 8.5 | 35.8 |
| Coronery artery SMC TNFalpha + IL-1beta | 12.9 | 21.6 | 27.4 | 17.8 |
| Astrocytes rest | 17.1 | 14.9 | 23.8 | 24.3 |
| Astrocytes TNFalpha + IL-1beta | 32.8 | 29.5 | 28.1 | 35.1 |
| KU-812 (Basophil) rest | 1.0 | 1.8 | 1.3 | 0.7 |
| KU-812 (Basophil) PMA/ionomycin | 1.4 | 3.3 | 2.0 | 3.7 |
| CCD1106 (Keratinocytes) none | 1.4 | 0.2 | 0.7 | 2.7 |
| CCD1106 (Keratinocytes) TNFalpha + IL-1beta | 0.9 | 0.3 | 0.8 | 1.3 |
| Liver cirrhosis | 2.9 | 3.0 | 2.4 | 4.8 |
| Lupus kidney | 3.0 | 2.9 | 0.9 | 4.4 |
| NCI-H292 none | 10.4 | 13.7 | 5.6 | 18.8 |
| NCI-H292 IL-4 | 14.2 | 14.9 | 6.8 | 17.1 |
| NCI-H292 IL-9 | 13.2 | 16.7 | 9.3 | 12.8 |
| NCI-H292 IL-13 | 9.4 | 8.6 | 15.9 | 9.0 |
| NCI-H292 IFN gamma | 3.8 | 4.7 | 4.7 | 5.3 |
| HPAEC none | 1.2 | 1.0 | 1.6 | 2.8 |
| HPAEC TNFalpha + IL-1 beta | 5.8 | 2.6 | 4.7 | 6.0 |
| Lung fibroblast none | 100.0 | 100.0 | 100.0 | 100.0 |
| Lung fibroblast TNF alpha + IL-1beta | 8.5 | 12.2 | 15.9 | 15.2 |
| Lung fibroblast IL-4 | 74.2 | 79.6 | 45.7 | 97.3 |
| Lung fibroblast IL-9 | 27.7 | 48.6 | 30.6 | 50.3 |
| Lung fibroblast IL-13 | 48.0 | 39.5 | 27.4 | 55.9 |
| Lung fibroblast IFN gamma | 76.3 | 82.9 | 42.6 | 98.6 |
| Dermal fibroblast CCD1070 rest | 52.9 | 56.3 | 27.2 | 65.5 |
| Dermal fibroblast CCD1070 TNFalpha | 33.9 | 42.6 | 19.8 | 46.7 |

TABLE 39-continued

Panel 4D

| Tissue Name | Rel. Exp. (%) Ag1522, Run 145789191 | Rel. Exp. (%) Ag1848, Run 160202841 | Rel. Exp. (%) Ag2263, Run 151562852 | Rel. Exp. (%) Ag2422, Run 159318890 |
|---|---|---|---|---|
| Dermal fibroblast CCD1070 IL-1beta | 29.1 | 27.9 | 70.2 | 28.9 |
| Dermal fibroblast IFN gamma | 6.1 | 3.6 | 8.9 | 7.9 |
| Dermal fibroblast IL-4 | 14.5 | 16.2 | 17.3 | 18.9 |
| IBD Colitis 2 | 0.1 | 0.1 | 0.2 | 0.5 |
| IBD Crohn's | 0.6 | 0.4 | 0.0 | 0.8 |
| Colon | 7.6 | 6.4 | 8.0 | 11.3 |
| Lung | 59.5 | 75.8 | 47.6 | 74.7 |
| Thymus | 16.5 | 17.3 | 10.2 | 19.6 |
| Kidney | 6.8 | 9.0 | 3.0 | 6.5 |

TABLE 40

Panel CNS_1

| Tissue Name | Rel. Exp. (%) Ag2263, Run 171669090 | Tissue Name | Rel. Exp. (%) Ag2263, Run 171669090 |
|---|---|---|---|
| BA4 Control | 22.8 | BA17 PSP | 11.2 |
| BA4 Control2 | 38.2 | BA17 PSP2 | 7.1 |
| BA4 Alzheimer's2 | 3.7 | Sub Nigra Control | 100.0 |
| BA4 Parkinson's | 45.7 | Sub Nigra Control2 | 51.8 |
| BA4 Parkinson's2 | 31.2 | Sub Nigra Alzheimer's2 | 30.8 |
| BA4 Huntington's | 12.3 | Sub Nigra Parkinson's2 | 89.5 |
| BA4 Huntington's2 | 12.2 | Sub Nigra Huntington's | 59.0 |
| BA4 PSP | 13.6 | Sub Nigra Huntington's2 | 16.2 |
| BA4 PSP2 | 42.6 | Sub Nigra PSP2 | 22.5 |
| BA4 Depression | 27.9 | Sub Nigra Depression | 40.6 |
| BA4 Depression2 | 10.9 | Sub Nigra Depression2 | 12.8 |
| BA7 Control | 28.3 | Glob Palladus Control | 36.1 |
| BA7 Control2 | 27.2 | Glob Palladus Control2 | 21.3 |
| BA7 Alzheimer's2 | 5.5 | Glob Palladus Alzheimer's | 26.1 |
| BA7 Parkinson's | 13.2 | Glob Palladus Alzheimer's2 | 11.2 |
| BA7 Parkinson's2 | 12.8 | Glob Palladus Parkinson's | 73.2 |
| BA7 Huntington's | 14.8 | Glob Palladus Parkinson's2 | 15.7 |
| BA7 Huntington's2 | 22.2 | Glob Palladus PSP | 15.0 |
| BA7 PSP | 29.1 | Glob Palladus PSP2 | 10.4 |
| BA7 PSP2 | 8.9 | Glob Palladus Depression | 28.3 |
| BA7 Depression | 5.4 | Temp Pole Control | 5.4 |
| BA9 Control | 14.3 | Temp Pole Control2 | 25.2 |
| BA9 Control2 | 57.0 | Temp Pole Alzheimer's | 10.0 |
| BA9 Alzheimer's | 5.5 | Temp Pole Alzheimer's2 | 2.5 |
| BA9 Alzheimer's2 | 13.8 | Temp Pole Parkinson's | 15.5 |
| BA9 Parkinson's | 16.2 | Temp Pole Parkinson's2 | 27.9 |
| BA9 Parkinson's2 | 21.0 | Temp Pole Huntington's | 22.4 |
| BA9 Huntington's | 21.5 | Temp Pole PSP | 1.3 |
| BA9 Huntington's2 | 11.9 | Temp Pole PSP2 | 6.4 |

TABLE 40-continued

Panel CNS_1

| Tissue Name | Rel. Exp. (%) Ag2263, Run 171669090 | Tissue Name | Rel. Exp. (%) Ag2263, Run 171669090 |
|---|---|---|---|
| BA9 PSP | 27.7 | Temp Pole Depression2 | 12.3 |
| BA9 PSP2 | 5.9 | Cing Gyr Control | 48.3 |
| BA9 Depression | 11.0 | Cing Gyr Control2 | 28.1 |
| BA9 Depression2 | 9.5 | Cing Gyr Alzheimer's | 27.2 |
| BA17 Control | 25.0 | Cing Gyr Alzheimer's2 | 13.1 |
| BA17 Control2 | 45.7 | Cing Gyr Parkinson's | 29.7 |
| BA17 Alzheimer's2 | 6.5 | Cing Gyr Parkinson's2 | 37.4 |
| BA17 Parkinson's | 35.4 | Cing Gyr Huntington's | 70.7 |
| BA17 Parkinson's2 | 15.3 | Cing Gyr Huntington's2 | 32.1 |
| BA17 Huntington's | 15.5 | Cing Gyr PSP | 42.6 |
| BA17 Huntington's2 | 8.1 | Cing Gyr PSP2 | 8.3 |
| BA17 Depression | 26.2 | Cing Gyr Depression | 20.6 |
| BA17 Depression2 | 59.9 | Cing Gyr Depression2 | 36.3 |

AI_comprehensive panel_v1.0 Summary: Ag1522/1848: The results of two runs with the same probe and primer set are in good agreement. Low to moderate levels of expression of the NOV11 gene are detected in samples derived from osteoarthritic (OA) bone and adjacent bone as well as OA cartilage, OA synovium and OA synovial fluid samples. Low level expression is also detected in cartilage, bone, synovium and synovial fluid samples from rheumatoid arthritis patients. With the exception of the cartilage Rep20 sample, no significant expression is detected in normal samples of cartilage, synovium, bone or synovial fluid cells. Low level expression is also detected in samples derived from normal lung samples, COPD lung, emphysema, atopic asthma, asthma, allergy, Crohn's disease (normal matched control and diseased), ulcerative colitis (normal matched control and diseased), and psoriasis (normal matched control and diseased). Therefore, therapeutic modulation of this gene product may ameliorate symptoms/conditions associated with autoimmune and inflammatory disorders including psoriasis, allergy, asthma, inflammatory bowel disease, rheumatoid arthritis and osteoarthritis.

CNS_neurodegeneration_v1.0 Summary: Ag1848/Ag2263/Ag2422 Multiple experiments using different probe/primer sets produce results that are in good agreement. Highest expression of the NOV11 gene is detected in the occipital cortex of a control patient. Significant levels of expression are also detected in the hippocampus, inferior temporal cortex, and the superior temporal cortex of brain tissue from an Alzheimer's patient.

Based on its homology, the NOV11 gene product is most similar to an UNC5H receptor, which as a class are known to act both in axon guidance and neuronal migration during development, as well as inducers of apoptosis (except when stimulated by the ligand netrin-1). Panel CNS_Neurodegeneration_V1.0 shows a moderate increase (1.5 to 2-fold) in the temporal cortex of the Alzheimer's disease brain when compared to non-demented elderly either with or without a high amyloid plaque load [this difference is apparent after scaling the RTQ-PCR data based upon overall RNA amount/quality, and is most apparent on Aq2263].

Thus, the NOV11 gene represents a protein that differentiates demented and non-demented elderly who have a severe amyloid plaque load, making it an excellent drug target in Alzheimer's disease. The modulation and/or selective stimulation of this receptor may be of use in enhancing or directing compensatory synaptogenesis and axon/dendritic outgrowth in response to neuronal death (stroke, head trauma) neurodegeneration (Alzheimer's, Parkinson's, Huntington's, spinocerebellar ataxia, progressive supranuclear palsy) or spinal cord injury. Furthermore, antagonism of this receptor may decrease apoptosis in Alzheimer's disease.

REFERENCES

Ellezam B, Selles-Navarro I, Manitt C, Kennedy T E, McKerracher L. Expression of netrin-1 and its receptors DCC and UNC-5H2 after axotomy and during regeneration of adult rat retinal ganglion cells. Exp Neurol 2001 March;168(1):105–15

Netrins are a family of chemotropic factors that guide axon outgrowth during development; however, their function in the adult CNS remains to be established. We examined the expression of the netrin receptors DCC and UNC5H2 in adult rat retinal ganglion cells (RGCs) after grafting a peripheral nerve (PN) to the transected optic nerve and following optic nerve transection alone. In situ hybridization revealed that both Dcc and Unc5h2 mRNAs are expressed by normal adult RGCs. In addition, netrin-1 was found to be constitutively expressed by RGCs. Quantitative analysis using in situ hybridization demonstrated that both Dcc and Unc5h2 were down-regulated by RGCs following axotomy. In the presence of an attached PN graft, Dcc and Unc5h2 were similarly down-regulated in surviving RGCs regardless of their success in regenerating an axon. Northern blot analysis demonstrated expression of netrin-1 in both optic and sciatic nerve, and Western blot analysis revealed the presence of netrin protein in both nerves. Immunohistochemical analysis indicated that netrin protein was closely associated with glial cells in the optic nerve. These results suggest that netrin-1, DCC, and UNC5H2 may contribute to regulating the regenerative capacity of adult RGCs.

Braisted I E, Catalano S M, Stimac R, Kennedy T E, Tessier-Lavigne M, Shatz C J, O'Leary D D Netrin-1 promotes thalamic axon growth and is required for proper development of the thalamocortical projection. J Neurosci 2000 Aug. 1;20(15):5792–801

The thalamocortical axon (TCA) projection originates in dorsal thalamus, conveys sensory input to the neocortex, and has a critical role in cortical development. We show that the secreted axon guidance molecule netrin-I acts in vitro as an attractant and growth promoter for dorsal thalamic axons and is required for the proper development of the TCA projection in vivo. As TCAs approach the hypothalamus, they turn laterally into the ventral telencephalon and extend toward the cortex through a population of netrin-1-expressing cells. DCC and neogenin, receptors implicated in mediating the attractant effects of netrin-1, are expressed in dorsal thalamus, whereas unc5h2 and unc5h3, netrin-1 receptors implicated in repulsion, are not. In vitro, dorsal thalamic axons show biased growth toward a source of netrin-1, which can be abolished by netrin-1-blocking antibodies. Netrin-I also enhances overall axon outgrowth from explants of dorsal thalamus. The biased growth of dorsal thalamic axons toward the internal capsule zone of ventral telencephalic explants is attenuated, but not significantly, by netrin-1-blocking antibodies, suggesting that it releases another attractant activity for TCAs in addition to netrin-1. Analyses of netrin-1−/− mice reveal that the TCA projection through the ventral telencephalon is disorganized, their pathway is abnormally restricted, and fewer dorsal thalamic axons reach cortex. These findings demonstrate that netrin-1 promotes the growth of TCAs through the ventral telencephalon and cooperates with other guidance cues to control their pathfinding from dorsal thalamus to cortex.

Panel 1.2 Summary: Ag1522 Expression of the NOV11 gene is highest in CNS cancer cell lines (CT=26.1). Of nine tissue samples derived from CNS cancer cell lines, expression of the NOV11 gene occurs in all samples, with expression high (CT=26.1, 26.6, 27.6) in three samples, moderate in five samples and low in one sample. High expression is also detectable in melanoma cell lines (CT=27.9). Significant expression of the NOV11 gene is seen in gastric cancer (28.1) and all ten samples of lung cancer cell lines in this sample. Thus, expression of the NOV11 gene could be used to distinguish those cancer cell lines from normal tissues. In addition, therapeutic modulation of the expression, or activity of the NOV11 gene product, might be of use in the treatment of melanoma, gastric cancer, lung cancer and brain cancer.

Panel 1.3D Summary: Ag1522/Ag1848/Ag2263/Ag2422 Four experiments using different probe/primer sets on the same tissue panel produce results that are in excellent agreement. In all four experiments, highest expression of the NOV11 gene is detected in CNS cancer cell lines. Expression is also significant in lung cancer and melanoma cell lines and in healthy brain tissue from the hippocampus and thalamus regions. Thus, the expression of the NOV11 gene could be used to distinguish these tissue samples from other samples. Moreover, therapeutic modulation of the expression, or function, of the NOV11 gene, through the use of small molecule drugs or antibodies, might be beneficial in the treatment of melanoma, lung cancer and brain cancer.

Among metabolic tissues, there is high expression of the NOV11 gene in adult heart tissue (CT=27.8) and moderate expression in fetal heart, adult and fetal liver, pancreas, adrenal gland, thyroid and pituitary. The NOV11 gene appears to be differentially expressed in fetal (CT value=31) and adult skeletal muscle (CT value=37) using the probe and primer set Ag1848 and may be useful for the differentiation of the adult from the fetal phenotype in this tissue.

Panel 2D Summary: Ag1522/Ag1848/Ag2263/Ag2422 Results from multiple experiments with four different probe and primer sets are in very good agreement. In all experiments, highest expression of the NOV11 gene is detected in thyroid and ovarian cancers (CTs=27–30), with lower expression also seen in most of the other tissues on this panel. Thus, the expression of the NOV11 gene could be used to distinguish ovarian and thyroid cancer cell lines from other tissues. Moreover, therapeutic modulation of the expression this gene, or its function, through the use of small molecule drugs or antibodies, might be of benefit in the treatment of ovarian and thyroid cancer. In addition, experiments with Ag2263 show differential expression between samples derived from lung cancer and their adjacent normal tissues. Thus, expression of the NOV11 gene could be used to distinguish cancerous lung tissue from normal lung tissue. Moreover, therapeutic modulation of the expression or function of this gene or its protein product, through the use of antibodies or small molecule drugs, might be of benefit in the treatment of lung cancer.

Panel 3D Summary: Ag2263 Expression of the NOV11 gene occurs at moderate levels across all the tissues in this panel. Highest expression is detected in a small cell lung cancer (CT=30.6) and neuroblastoma (CT=30.7). In addition, significant expression is detected in a cluster of small cell lung cancer lines. Thus, this gene could be used to distinguish lung cancer cell lines from other samples. Moreover, therapeutic modulation of the NOV11 gene or its protein products through the use of small molecule drugs or antibodies might be of benefit in the treatment of small cell lung cancer.

Panel 4D Summary: Ag1522/Ag1848/Ag2263/Ag2422 Experiments using each of the four probe and primer sets that correspond to the NOV11 gene produce results that are in excellent agreement. In all the experiments, expression of the NOV11 gene occurs at moderate to low levels in many of the tissues in the sample. Highest expression in each experiment occurs in lung fibroblasts (CT=29). Moderate expression in lung fibroblasts treated with IL-4 is also consistent among all four experiments (CT=30). Lower expression is also detected in a variety of fibroblasts, endothelial and smooth muscle cells. The expression of the NOV11 gene produces a complex profile; it is upregulated by TNF-alpha in small airway epithelium, but clearly down-regulated by the same stimulus in lung fibroblasts. The gene most probably encodes a netrin receptor that may be important in understanding cell migration. Regulation of the protein encoded for by the NOV11 gene could potentially control the progression of keloid formation, emphysema and other conditions in which TNF-alpha and IL-1 beta are present and tissue remodeling may occur.

Panel CNS_1 Summary: Ag2263 Expression of the NOV11 gene is moderate to low across many of the tissues in this panel. Highest expression is detected in the substantia nigra (CT=31.4). Although no disease-specific expression is seen in this panel, the expression profile confirms the expression of this gene in the central nervous system. Please see panel_CNS_neurodegeneration for potential utility of the NOV11 gene regarding the CNS.

NOV10

Expression of gene NOV10 was assessed using the primer-probe set Ag2421, described in Table 41. Results of the RTQ-PCR runs are shown in Tables 42 and 43.

TABLE 41

Probe Name Ag2421

| Primers | Sequences | Length | Start Position | SEQ ID NO: |
|---|---|---|---|---|
| Forward | 5'-tgaggctgagctctctgtgt-3' | 20 | 1952 | 179 |
| Probe | TET-5'-tctgctaactgtgaaggatctcacca-3'-TAMRA | 26 | 1985 | 180 |
| Reverse | 5'-ctggtccacattgtcaggaa-3' | 20 | 2014 | 181 |

TABLE 42

Panel 1.3D

| Tissue Name | Rel. Exp. (%) Ag2421, Run 159299536 | Tissue Name | Rel. Exp. (%) Ag2421, Run 159299536 |
|---|---|---|---|
| Liver adenocarcinoma | 0.0 | Kidney (fetal) | 0.6 |
| Pancreas | 0.0 | Renal ca. 786-0 | 0.0 |
| Pancreatic ca. CAPAN 2 | 0.0 | Renal ca. A498 | 0.0 |
| Adrenal gland | 0.0 | Renal ca. RXF 393 | 0.0 |
| Thyroid | 0.0 | Renal ca. ACHN | 0.0 |
| Salivary gland | 0.0 | Renal ca. UO-31 | 0.0 |
| Pituitary gland | 0.0 | Renal ca. TK-10 | 0.0 |
| Brain (fetal) | 0.0 | Liver | 33.4 |
| Brain (whole) | 0.0 | Liver (fetal) | 0.0 |
| Brain (amygdala) | 0.0 | Liver ca. (hepatoblast) HepG2 | 0.0 |
| Brain (cerebellum) | 0.0 | Lung | 26.2 |
| Brain (hippocampus) | 8.4 | Lung (fetal) | 8.7 |
| Brain (substantia nigra) | 0.0 | Lung ca. (small cell) LX-1 | 0.0 |
| Brain (thalamus) | 10.4 | Lung ca. (small cell) NCI-H69 | 0.0 |
| Cerebral Cortex | 0.0 | Lung ca. (s.cell var.) SHP-77 | 0.0 |
| Spinal cord | 1.1 | Lung ca. (large cell)NCI-H460 | 0.0 |
| glio/astro U87-MG | 0.0 | Lung ca. (non-sm. cell) A549 | 0.0 |
| glio/astro U-118-MG | 0.0 | Lung ca. (non-s.cell) NCI-H23 | 0.0 |
| astrocytoma SW1783 | 0.0 | Lung ca. (non-s.cell) HOP-62 | 0.0 |
| neuro*; met SK-N-AS | 0.0 | Lung ca. (non-s.cl) NCI-H522 | 0.0 |
| astrocytoma SF-539 | 0.0 | Lung ca. (squam.) SW 900 | 0.0 |
| astrocytoma SNB-75 | 1.4 | Lung ca. (squam.) NCI-H596 | 0.0 |
| glioma SNB-19 | 0.0 | Mammary gland | 0.0 |
| glioma U251 | 0.0 | Breast ca.* (pl.ef) MCF-7 | 0.0 |
| glioma SF-295 | 0.0 | Breast ca.* (pl.ef) MDA-MB-231 | 0.0 |
| Heart (fetal) | 0.0 | Breast ca.* (pl.ef) T47D | 0.0 |
| Heart | 0.0 | Breast ca. BT-549 | 0.0 |
| Skeletal muscle (fetal) | 0.0 | Breast ca. MDA-N | 0.0 |
| Skeletal muscle | 0.0 | Ovary | 1.5 |
| Bone marrow | 0.0 | Ovarian ca. OVCAR-3 | 0.0 |
| Thymus | 0.0 | Ovarian ca. OVCAR-4 | 0.0 |
| Spleen | 0.0 | Ovarian ca. OVCAR-5 | 0.0 |
| Lymph node | 0.0 | Ovarian ca. OVCAR-8 | 0.0 |
| Colorectal | 0.0 | Ovarian ca. IGROV-1 | 0.0 |
| Stomach | 0.0 | Ovarian ca.* (ascites) SK-OV-3 | 0.0 |
| Small intestine | 0.0 | Uterus | 0.0 |
| Colon ca. SW480 | 0.0 | Placenta | 0.0 |
| Colon ca.* SW620(SW480 met) | 0.0 | Prostate | 0.0 |
| Colon ca. HT29 | 0.0 | Prostate ca.* (bone met)PC-3 | 0.0 |
| Colon ca. HCT-116 | 0.0 | Testis | 0.0 |
| Colon ca. CaCo-2 | 4.2 | Melanoma Hs688(A).T | 0.0 |

TABLE 42-continued

Panel 1.3D

| Tissue Name | Rel. Exp. (%) Ag2421, Run 159299536 | Tissue Name | Rel. Exp. (%) Ag2421, Run 159299536 |
|---|---|---|---|
| Colon ca. tissue(ODO3866) | 0.0 | Melanoma* (met) Hs688(B).T | 0.0 |
| Colon ca. HCC-2998 | 0.0 | Melanoma UACC-62 | 0.0 |
| Gastric ca.* (liver met) NCI-N87 | 0.0 | Melanoma M14 | 0.0 |
| Bladder | 0.0 | Melanoma LOX IMVI | 0.0 |
| Trachea | 100.0 | Melanoma* (met) SK-MEL-5 | 0.0 |
| Kidney | 0.0 | Adipose | 0.0 |

TABLE 43

Panel 2D

| Tissue Name | Rel. Exp. (%) Ag2421, Run 159298043 | Tissue Name | Rel. Exp. (%) Ag2421, Run 159298043 |
|---|---|---|---|
| Normal Colon | 0.0 | Kidney Margin 8120608 | 0.0 |
| CC Well to Mod Diff (ODO3866) | 0.0 | Kidney Cancer 8120613 | 0.0 |
| CC Margin (ODO3866) | 0.0 | Kidney Margin 8120614 | 0.4 |
| CC Gr.2 rectosigmoid (ODO3868) | 0.0 | Kidney Cancer 9010320 | 0.0 |
| CC Margin (ODO3868) | 0.0 | Kidney Margin 9010321 | 0.0 |
| CC Mod Diff (ODO3920) | 0.0 | Normal Uterus | 0.0 |
| CC Margin (ODO3920) | 0.0 | Uterus Cancer 064011 | 1.0 |
| CC Gr.2 ascend colon (ODO3921) | 0.0 | Normal Thyroid | 0.0 |
| CC Margin (ODO3921) | 0.0 | Thyroid Cancer 064010 | 0.0 |
| CC from Partial Hepatectomy (ODO4309) Mets | 7.7 | Thyroid Cancer A302152 | 0.0 |
| Liver Margin (ODO4309) | 99.3 | Thyroid Margin A302153 | 0.0 |
| Colon mets to lung (OD04451-01) | 0.1 | Normal Breast | 0.0 |
| Lung Margin (OD04451-02) | 0.4 | Breast Cancer (OD04566) | 0.0 |
| Normal Prostate 6546-1 | 0.0 | Breast Cancer (OD04590-01) | 0.0 |
| Prostate Cancer (OD04410) | 0.0 | Breast Cancer Mets (OD04590-03) | 0.0 |
| Prostate Margin (OD04410) | 0.0 | Breast Cancer Metastasis (OD04655-05) | 0.0 |
| Prostate Cancer (OD04720-01) | 0.0 | Breast Cancer 064006 | 0.2 |
| Prostate Margin (OD04720-02) | 0.0 | Breast Cancer 1024 | 0.0 |
| Normal Lung 061010 | 4.0 | Breast Cancer 9100266 | 0.0 |
| Lung Met to Muscle (ODO4286) | 0.0 | Breast Margin 9100265 | 0.0 |
| Muscle Margin (ODO4286) | 0.0 | Breast Cancer A209073 | 0.0 |
| Lung Malignant Cancer (OD03126) | 2.6 | Breast Margin A2090734 | 0.0 |
| Lung Margin (OD03126) | 2.3 | Normal Liver | 57.8 |
| Lung Cancer (OD04404) | 0.2 | Liver Cancer 064003 | 0.0 |
| Lung Margin (OD04404) | 1.6 | Liver Cancer 1025 | 0.4 |
| Lung Cancer (OD04565) | 0.1 | Liver Cancer 1026 | 2.1 |
| Lung Margin (OD04565) | 0.8 | Liver Cancer 6004-T | 0.7 |
| Lung Cancer (OD04237-01) | 0.1 | Liver Tissue 6004-N | 1.4 |

TABLE 43-continued

Panel 2D

| Tissue Name | Rel. Exp. (%) Ag2421, Run 159298043 | Tissue Name | Rel. Exp. (%) Ag2421, Run 159298043 |
|---|---|---|---|
| Lung Margin (OD04237-02) | 1.2 | Liver Cancer 6005-T | 1.5 |
| Ocular Mel Met to Liver (ODO4310) | 0.2 | Liver Tissue 6005-N | 7.0 |
| Liver Margin (ODO4310) | 100.0 | Normal Bladder | 0.0 |
| Melanoma Mets to Lung (OD04321) | 0.0 | Bladder Cancer 1023 | 0.0 |
| Lung Margin (OD04321) | 1.5 | Bladder Cancer A302173 | 0.4 |
| Normal Kidney | 0.0 | Bladder Cancer (OD04718-01) | 0.0 |
| Kidney Ca, Nuclear grade 2 (OD04338) | 0.0 | Bladder Normal Adjacent (OD04718-03) | 0.1 |
| Kidney Margin (OD04338) | 0.0 | Normal Ovary | 0.0 |
| Kidney Ca Nuclear grade 1/2 (OD04339) | 0.0 | Ovarian Cancer 064008 | 0.0 |
| Kidney Margin (OD04339) | 0.0 | Ovarian Cancer (OD04768-07) | 0.0 |
| Kidney Ca, Clear cell type (OD04340) | 0.0 | Ovary Margin (OD04768-08) | 0.0 |
| Kidney Margin (OD04340) | 0.0 | Normal Stomach | 0.0 |
| Kidney Ca, Nuclear grade 3 (OD04348) | 0.0 | Gastric Cancer 9060358 | 0.0 |
| Kidney Margin (OD04348) | 0.0 | Stomach Margin 9060359 | 0.0 |
| Kidney Cancer (OD04622-01) | 0.0 | Gastric Cancer 9060395 | 0.0 |
| Kidney Margin (OD04622-03) | 0.0 | Stomach Margin 9060394 | 0.0 |
| Kidney Cancer (OD04450-01) | 0.0 | Gastric Cancer 9060397 | 0.0 |
| Kidney Margin (OD04450-03) | 0.0 | Stomach Margin 9060396 | 0.0 |
| Kidney Cancer 8120607 | 0.0 | Gastric Cancer 064005 | 0.0 |

Panel 1.3D Summary: Ag2421 Expression of the NOV10 gene is restricted to samples from liver, lung and trachea in this panel (CTs=32–33), while none of the cancer cell lines appear to make this protein. Thus, lack of expression of this gene might be significant for cell proliferation and growth.

Furthermore, the difference in expression between adult liver and fetal liver (CT=40) could be used to distinguish between the two sources of liver tissue.

Panel 2D Summary: Ag2421 The NOV10 gene encodes a protein homologous to pregnancy zone protein (PZP), a liver protein, and is expressed primarily in liver tissue. This gene shows a higher level of expression in normal liver than the matched tumor tissue, metastatic melanoma and metastatic colon cancer. There is also higher expression in normal lung compared to lung cancer samples. This expression profile is in agreement with the results from Panel 1.3D. Thus, this expression could potentially be used as a diagnostic marker for liver and lung cancer. Furthermore, the protein product could potentially be used as a therapy for lung and liver cancer.

REFERENCES

Mavroidis M, Sunyer J O, Lambris J D. Isolation, primary structure, and evolution of the third component of chicken complement and evidence for a new member of the alpha 2-macroglobulin family. J Immunol 1995 Mar. 1;154(5):2164–74

Although the third component of complement, C3, has been isolated and its primary structure determined from most living classes of vertebrate, limited information is available on its structure and function for aves, which represent a significant stage in complement evolution. In this study, we present the complete cDNA sequence of chicken C3, the cDNA sequences of the thioester region for two chicken alpha 2-macroglobulin (alpha 2M)-related proteins, a simplified method for purifying chicken C3, and an analysis of the C3 convertase and factor I-mediated cleavages in chicken C3. Using the reverse-transcriptase PCR, with degenerate oligonucleotide primers derived from two conserved C3 sequences (GCGEQN/TM, TWLTAY/FV) and liver mRNA as template, we isolated three distinct 220-bp PCR products, one with a high degree of sequence similarity to C3 and two to alpha 2M and pregnancy zone protein from other species. The complete cDNA sequence of chicken C3 was obtained by screening a chicken liver lambda gt10 library with the C3 PCR product and probes from the 5' end of the partial-length C3 clones. The obtained sequence is in complete agreement with the protein sequence of several tryptic peptides of purified chicken C3. Chicken pro-C3 consists of an 18-residue putative signal peptide, a 640-residue beta-chain (70 kDa), a 989-residue alpha-chain (11 kDa), and an RXRR linker region. It contains an internal thioester and three potential N-glycosylation sites, all in the alpha-chain. The convertase cleavage site, predicted to be Arg-Ser, was confirmed by sequencing the zymosan-bound C3 fragments generated upon complement activation. NH2-terminal sequencing of the purified C3 chains showed that 1) pro-C3 is indeed cleaved at the RKRR linker sequence to generate the mature two-chain molecule, and 2) the beta-chain of chicken C3 is blocked. The deduced amino acid sequence shows 54, 54, 54, 53, 52, 57, and 55% amino acid identities to human, mouse, rat, guinea pig, rabbit, cobra, and *Xenopus* C3, respectively, and an identity of 44, 31, and 33% to trout, hagfish, and lamprey C3, respectively. The identities to human C4, C5, and alpha 2M are 31, 29 and 23%, respectively. A phylogenetic tree for C3, C4, C5, and alpha 2M-related proteins was constructed based on the sequence data and is discussed.
PMID: 7532662

Panel 4D Summary: Ag2421 Results from one experiment with the NOV10 gene are not included. The amp plot indicates that there is a high probability of a probe failure. (Data not shown.)

NOV9

Expression of gene NOV9 was assessed using the primer-probe set Ag2873, described in Table 44.

TABLE 46

CNS_neurodegeneration_v1.0

| Tissue Name | Rel. Exp. (%) Ag2878, Run 209058909 | Tissue Name | Rel. Exp. (%) Ag2878, Run 209058909 |
|---|---|---|---|
| AD 1 Hippo | 14.7 | Control (Path) 3 Temporal Ctx | 10.4 |
| AD 2 Hippo | 58.6 | Control (Path) 4 Temporal Ctx | 36.9 |
| AD 3 Hippo | 4.9 | AD 1 Occipital Ctx | 8.0 |
| AD 4 Hippo | 38.2 | AD 2 Occipital Ctx (Missing) | 0.0 |
| AD 5 Hippo | 44.1 | AD 3 Occipital Ctx | 6.0 |
| AD 6 Hippo | 100.0 | AD 4 Occipital Ctx | 27.0 |
| Control 2 Hippo | 18.8 | AD 5 Occipital Ctx | 24.0 |
| Control 4 Hippo | 24.3 | AD 6 Occipital Ctx | 22.7 |
| Control (Path) 3 Hippo | 9.6 | Control 1 Occipital Ctx | 7.9 |
| AD 1 Temporal Ctx | 18.0 | Control 2 Occipital Ctx | 23.2 |
| AD 2 Temporal Ctx | 64.2 | Control 3 Occipital Ctx | 20.6 |

TABLE 44

Probe Name Ag2873

| Primers | Sequences | Length | Start Position | SEQ ID NO: |
|---|---|---|---|---|
| Forward | 5'-ccctgctcacaagactgactag-3' | 22 | 1025 | 182 |
| Probe | TET-5'-ctccacgcagtttcaggcatgaag-3'-TAMRA | 24 | 1054 | 183 |
| Reverse | 5'-gacattaggagacaacctccaa-3' | 22 | 1080 | 184 |

CNS_neurodegeneration_v1.0 Summary: Ag2873 Expression of the NOV9 gene is low/undetectable in all samples on this panel. (CTs>35). (Data not shown.)

Panel 1.3D Summary: Ag2873 Expression of the NOV9 gene is low/undetectable in all samples on this panel. (CTs>35). (Data not shown.)

Panel 2D Summary: Ag2873 Expression of the NOV9 gene is low/undetectable in all samples on this panel. (CTs>35). (Data not shown.)

Panel 4D Summary: Ag873 Results from experiment with the NOV9 gene are not included. The amp plot indicates that there were experimental difficulties with this run.

NOV7a

Expression of gene NOV7a was assessed using the primer-probe set Ag2878, described in Table 45. Results of the RTQ-PCR runs are shown in Tables 46, 47, and 48.

TABLE 46-continued

CNS_neurodegeneration_v1.0

| Tissue Name | Rel. Exp. (%) Ag2878, Run 209058909 | Tissue Name | Rel. Exp. (%) Ag2878, Run 209058909 |
|---|---|---|---|
| AD 3 Temporal Ctx | 7.4 | Control 4 Occipital Ctx | 11.8 |
| AD 4 Temporal Ctx | 46.0 | Control (Path) 1 Occipital Ctx | 57.8 |
| AD 5 Inf Temporal Ctx | 80.7 | Control (Path) 2 Occipital Ctx | 6.6 |
| AD 5 Sup Temporal Ctx | 46.3 | Control (Path) 3 Occipital Ctx | 3.7 |
| AD 6 Inf Temporal Ctx | 81.2 | Control (Path) 4 Occipital Ctx | 7.6 |

TABLE 45

Probe Name Ag2878

| Primers | Sequences | Length | Start Position | SEQ ID NO: |
|---|---|---|---|---|
| Forward | 5'-catctctaagaatgccctcaga-3' | 22 | 490 | 185 |
| Probe | TET-5'-cttcgctcgcttacacacctaagcct-3'-TAMRA | 26 | 515 | 186 |
| Reverse | 5'-gagggtctccagatggttattg-3' | 22 | 544 | 187 |

TABLE 46-continued

CNS_neurodegeneration_v1.0

| Tissue Name | Rel. Exp. (%) Ag2878, Run 209058909 | Tissue Name | Rel. Exp. (%) Ag2878, Run 209058909 |
|---|---|---|---|
| AD 6 Sup Temporal Ctx | 97.3 | Control 1 Parietal Ctx | 18.9 |
| Control 1 Temporal Ctx | 18.4 | Control 2 Parietal Ctx | 59.0 |
| Control 2 Temporal Ctx | 38.7 | Control 3 Parietal Ctx | 20.2 |
| Control 3 Temporal Ctx | 28.3 | Control (Path) 1 Parietal Ctx | 65.1 |
| Control 3 Temporal Ctx | 26.8 | Control (Path) 2 Parietal Ctx | 23.2 |
| Control (Path) 1 Temporal Ctx | 58.2 | Control (Path) 3 Parietal Ctx | 13.4 |
| Control (Path) 2 Temporal Ctx | 30.8 | Control (Path) 4 Parietal Ctx | 24.8 |

TABLE 47

Panel 1.3D

| Tissue Name | Rel. Exp. (%) Ag2878, Run 167646344 | Tissue Name | Rel. Exp. (%) Ag2878, Run 167646344 |
|---|---|---|---|
| Liver adenocarcinoma | 0.0 | Kidney (fetal) | 10.1 |
| Pancreas | 0.0 | Renal ca. 786-0 | 0.0 |
| Pancreatic ca. CAPAN 2 | 0.0 | Renal ca. A498 | 0.0 |
| Adrenal gland | 0.0 | Renal ca. RXF 393 | 0.0 |
| Thyroid | 0.0 | Renal ca. ACHN | 0.0 |
| Salivary gland | 0.0 | Renal ca. UO-31 | 0.0 |
| Pituitary gland | 0.0 | Renal ca. TK-10 | 0.0 |
| Brain (fetal) | 60.7 | Liver | 2.1 |
| Brain (whole) | 34.2 | Liver (fetal) | 2.4 |
| Brain (amygdala) | 43.5 | Liver ca. (hepatoblast) HepG2 | 0.0 |
| Brain (cerebellum) | 100.0 | Lung | 2.9 |
| Brain (hippocampus) | 17.9 | Lung (fetal) | 3.2 |
| Brain (substantia nigra) | 81.2 | Lung ca. (small cell) LX-1 | 0.0 |
| Brain (thalamus) | 23.3 | Lung ca. (small cell) NCI-H69 | 0.0 |
| Cerebral Cortex | 51.4 | Lung ca. (s.cell var.) SHP-77 | 0.0 |
| Spinal cord | 69.7 | Lung ca. (large cell)NCI-H460 | 0.0 |
| glio/astro U87-MG | 0.0 | Lung ca. (non-sm. cell) A549 | 0.0 |
| glio/astro U-118-MG | 0.0 | Lung ca. (non-s.cell) NCI-H23 | 0.0 |
| astrocytoma SW1783 | 0.0 | Lung ca. (non-s.cell) HOP-62 | 0.0 |
| neuro*; met SK-N-AS | 0.0 | Lung ca. (non-s.cl) NCI-H522 | 0.0 |
| astrocytoma SF-539 | 0.0 | Lung ca. (squam.) SW 900 | 0.0 |
| astrocytoma SNB-75 | 0.0 | Lung ca. (squam.) NCI-H596 | 0.0 |
| glioma SNB-19 | 0.0 | Mammary gland | 4.4 |
| glioma U251 | 0.0 | Breast ca.* (pl.ef) MCF-7 | 0.0 |
| glioma SF-295 | 0.0 | Breast ca.* (pl.ef) MDA-MB-231 | 0.0 |
| Heart (fetal) | 7.3 | Breast ca.* (pl.ef) T47D | 0.0 |
| Heart | 4.0 | Breast ca. BT-549 | 0.0 |
| Skeletal muscle (fetal) | 8.6 | Breast Ca. MDA-N | 0.0 |
| Skeletal muscle | 18.2 | Ovary | 0.0 |
| Bone marrow | 0.0 | Ovarian ca. OVCAR-3 | 0.0 |
| Thymus | 0.0 | Ovarian ca. OVCAR-4 | 0.0 |
| Spleen | 0.0 | Ovarian ca. OVCAR-5 | 0.0 |
| Lymph node | 0.0 | Ovarian ca. OVCAR-8 | 0.0 |
| Colorectal | 5.8 | Ovarian ca. IGROV-1 | 0.0 |
| Stomach | 0.0 | Ovarian ca.* (ascites) SK-OV-3 | 0.0 |

TABLE 47-continued

Panel 1.3D

| Tissue Name | Rel. Exp. (%) Ag2878, Run 167646344 | Tissue Name | Rel. Exp. (%) Ag2878, Run 167646344 |
|---|---|---|---|
| Small intestine | 5.9 | Uterus | 17.0 |
| Colon ca. SW480 | 0.0 | Placenta | 0.0 |
| Colon ca.* SW620(SW480 met) | 0.0 | Prostate | 3.0 |
| Colon ca. HT29 | 0.0 | Prostate ca.* (bone met)PC-3 | 0.0 |
| Colon ca. HCT-116 | 0.0 | Testis | 0.0 |
| Colon ca. CaCo-2 | 0.0 | Melanoma Hs688(A).T | 0.0 |
| Colon ca. tissue(ODO3866) | 0.0 | Melanoma* (met) Hs688(B).T | 0.0 |
| Colon ca. HCC-2998 | 0.0 | Melanoma UACC-62 | 0.0 |
| Gastric ca.* (liver met) NCI-N87 | 0.0 | Melanoma M14 | 0.0 |
| Bladder | 0.0 | Melanoma LOX IMVI | 0.0 |
| Trachea | 0.0 | Melanoma* (met) SK-MEL-5 | 0.0 |
| Kidney | 0.0 | Adipose | 2.3 |

TABLE 48

Panel CNS_1

| Tissue Name | Rel. Exp. (%) Ag2878, Run 171688441 | Tissue Name | Rel. Exp. (%) Ag2878, Run 171688441 |
|---|---|---|---|
| BA4 Control | 16.5 | BA17 PSP | 12.2 |
| BA4 Control2 | 17.3 | BA17 PSP2 | 2.2 |
| BA4 Alzheimer's2 | 4.5 | Sub Nigra Control | 23.0 |
| BA4 Parkinson's | 49.7 | Sub Nigra Control2 | 8.8 |
| BA4 Parkinson's2 | 39.8 | Sub Nigra Alzheimer's2 | 4.4 |
| BA4 Huntington's | 50.7 | Sub Nigra Parkinson's2 | 42.0 |
| BA4 Huntington's2 | 11.3 | Sub Nigra Huntington's | 41.2 |
| BA4 PSP | 15.9 | Sub Nigra Huntington's2 | 13.6 |
| BA4 PSP2 | 13.9 | Sub Nigra PSP2 | 3.7 |
| BA4 Depression | 18.0 | Sub Nigra Depression | 5.5 |
| BA4 Depression2 | 6.5 | Sub Nigra Depression2 | 4.6 |
| BA7 Control | 15.0 | Glob Palladus Control | 12.1 |
| BA7 Control2 | 4.8 | Glob Palladus Control2 | 4.5 |
| BA7 Alzheimer's2 | 7.7 | Glob Palladus Alzheimer's | 6.7 |
| BA7 Parkinson's | 13.4 | Glob Palladus Alzheimer's2 | 7.3 |
| BA7 Parkinson's2 | 32.1 | Glob Palladus Parkinson's | 100.0 |
| BA7 Huntington's | 43.2 | Glob Palladus Parkinson's2 | 7.9 |
| BA7 Huntington's2 | 55.9 | Glob Palladus PSP | 1.6 |
| BA7 PSP | 40.1 | Glob Palladus PSP2 | 3.4 |
| BA7 PSP2 | 20.7 | Glob Palladus Depression | 4.1 |
| BA7 Depression | 18.0 | Temp Pole Control | 10.7 |
| BA9 Control | 18.7 | Temp Pole Control2 | 27.0 |
| BA9 Control2 | 47.3 | Temp Pole Alzheimer's | 5.0 |
| BA9 Alzheimer's | 4.6 | Temp Pole Alzheimer's2 | 10.7 |
| BA9 Alzheimer's2 | 17.4 | Temp Pole Parkinson's | 27.9 |
| BA9 Parkinson's | 35.6 | Temp Pole Parkinson's2 | 20.3 |
| BA9 Parkinson's2 | 33.2 | Temp Pole Huntington's | 59.0 |
| BA9 Huntington's | 94.0 | Temp Pole PSP | 5.2 |
| BA9 Huntington's2 | 20.6 | Temp Pole PSP2 | 1.7 |
| BA9 PSP | 16.0 | Temp Pole Depression2 | 4.7 |
| BA9 PSP2 | 3.1 | Cing Gyr Control | 47.0 |
| BA9 Depression | 14.8 | Cing Gyr Control2 | 16.8 |
| BA9 Depression2 | 9.5 | Cing Gyr Alzheimer's | 11.8 |
| BA17 Control | 20.6 | Cing Gyr Alzheimer's2 | 13.7 |
| BA17 Control2 | 7.3 | Cing Gyr Parkinson's | 31.4 |
| BA17 Alzheimer's2 | 4.3 | Cing Gyr Parkinson's2 | 27.2 |
| BA17 Parkinson's | 34.2 | Cing Gyr Huntington's | 85.9 |
| BA17 Parkinson's2 | 12.9 | Cing Gyr Huntington's2 | 15.4 |
| BA17 Huntington's | 26.4 | Cing Gyr PSP | 14.4 |
| BA17 Huntington's2 | 7.0 | Cing Gyr PSP2 | 3.5 |
| BA17 Depression | 14.2 | Cing Gyr Depression | 11.8 |
| BA17 Depression2 | 11.2 | Cing Gyr Depression2 | 7.3 |

CNS_neurodegeneration_v1.0 Summary: Ag2878 No differential expression of the NOV7a gene is found between Alzheimer's disease and control postmortem brains. This panel confirms the expression of this gene at moderate level in the CNS in an independent group of patients. Please see panel 1.3D for a discussion of utility of this gene in the central nervous system.

Panel 13D Summary: Ag2878 The expression of the NOV7a gene shows a CNS-preferential expression profile. Because it is not detected in any cancers, this gene is an excellent diagnostic device to differentiate normal CNS tissue from glioma. Furthermore, it may be useful as a tumor suppressor gene in the treatment of brain cancer.

Panel 4D Summary: Ag2878 Expression of the NOV7a gene is low/undetectable in all samples on this panel. (CTs>35). (Data not shown.)

Panel CNS_1 Summary: Ag2878 This panel confirms the expression of the NOV7a gene at moderate level in the CNS in an independent group of patients. Please see panel 1.3D for a discussion of utility of this gene in the central nervous system.

NOV6

Expression of gene NOV6 was assessed using the primer-probe set Ag1799, described in Table 49. Results of the RTQ-PCR runs are shown in Tables 50, 51 and 52.

TABLE 49

Probe Name Ag1799

| Primers | Sequences | Length | Start Position | SEQ ID NO: |
|---|---|---|---|---|
| Forward | 5'-gaccaacggctttcttcaag-3' | 20 | 680 | 188 |
| Probe | TET-5'-accttccttcttgcgacttggatcct-3'-TAMRA | 26 | 708 | 189 |
| Reverse | 5'-tcagttgttcaaagcacacaaa-3' | 22 | 748 | 190 |

TABLE 50

Panel 1.3D

| Tissue Name | Rel. Exp. (%) Ag1799, Run 156248690 | Tissue Name | Rel. Exp. (%) Ag1799, Run 156248690 |
|---|---|---|---|
| Liver adenocarcinoma | 0.0 | Kidney (fetal) | 8.4 |
| Pancreas | 0.0 | Renal ca. 786-0 | 0.0 |
| Pancreatic ca. CAPAN 2 | 0.0 | Renal ca. A498 | 1.3 |
| Adrenal gland | 100.0 | Renal ca. RXF 393 | 0.0 |
| Thyroid | 9.5 | Renal ca. ACHN | 0.0 |
| Salivary gland | 4.3 | Renal ca. UO-31 | 0.0 |
| Pituitary gland | 0.6 | Renal ca. TK-10 | 0.0 |
| Brain (fetal) | 0.0 | Liver | 0.0 |
| Brain (whole) | 0.0 | Liver (fetal) | 0.0 |
| Brain (amygdala) | 0.0 | Liver ca. (hepatoblast) HepG2 | 6.3 |
| Brain (cerebellum) | 0.0 | Lung | 0.6 |
| Brain (hippocampus) | 0.8 | Lung (fetal) | 8.9 |
| Brain (substantia nigra) | 0.0 | Lung ca. (small cell) LX-1 | 0.0 |
| Brain (thalamus) | 5.4 | Lung ca. (small cell) NCI-H69 | 11.8 |
| Cerebral Cortex | 0.0 | Lung ca. (s.cell var.) SHP-77 | 0.0 |
| Spinal cord | 0.0 | Lung ca. (large cell)NCI-H460 | 0.0 |
| glio/astro U87-MG | 0.0 | Lung ca. (non-sm. cell) A549 | 0.0 |
| glio/astro U-118-MG | 0.0 | Lung ca. (non-s.cell) NCI-H23 | 0.0 |
| astrocytoma SW1783 | 0.0 | Lung ca (non-s.cell) HOP-62 | 0.0 |
| neuro*; met SK-N-AS | 1.9 | Lung ca. (non-s.cl) NCI-H522 | 0.0 |
| astrocytoma SF-539 | 0.0 | Lung ca. (squam.) SW 900 | 0.0 |
| astrocytoma SNB-75 | 0.0 | Lung ca. (squam.) NCI-H596 | 0.0 |
| glioma SNB-19 | 0.0 | Mammary gland | 0.0 |
| glioma U251 | 0.0 | Breast ca.* (pl.ef) MCF-7 | 0.0 |
| glioma SF-295 | 0.0 | Breast ca.* (pl.ef) MDA-MB-231 | 0.0 |
| Heart (fetal) | 0.0 | Breast ca.* (pl.ef) T47D | 0.0 |
| Heart | 0.8 | Breast ca. BT-549 | 0.0 |
| Skeletal muscle (fetal) | 0.0 | Breast ca. MDA-N | 0.0 |

TABLE 50-continued

Panel 1.3D

| Tissue Name | Rel. Exp. (%) Ag1799, Run 156248690 | Tissue Name | Rel. Exp. (%) Ag1799, Run 156248690 |
|---|---|---|---|
| Skeletal muscle | 0.0 | Ovary | 0.0 |
| Bone marrow | 0.0 | Ovarian ca. OVCAR-3 | 0.0 |
| Thymus | 5.3 | Ovarian ca. OVCAR-4 | 0.0 |
| Spleen | 0.0 | Ovarian ca. OVCAR-5 | 0.0 |
| Lymph node | 8.9 | Ovarian ca. OVCAR-8 | 0.0 |
| Colorectal | 0.0 | Ovarian ca. IGROV-1 | 0.0 |
| Stomach | 0.0 | Ovarian ca.* (ascites) SK-OV-3 | 2.0 |
| Small intestine | 0.0 | Uterus | 0.0 |
| Colon ca. SW480 | 0.0 | Placenta | 0.0 |
| Colon ca.* SW620(SW480 met) | 0.0 | Prostate | 0.0 |
| Colon ca. HT29 | 0.0 | Prostate ca.* (bone met)PC-3 | 0.0 |
| Colon ca. HCT-116 | 0.0 | Testis | 0.8 |
| Colon ca. CaCo-2 | 0.8 | Melanoma Hs688(A).T | 0.0 |
| Colon ca. tissue(ODO3866) | 0.0 | Melanoma* (met) Hs688(B).T | 0.0 |
| Colon ca. HCC-2998 | 5.0 | Melanoma UACC-62 | 0.0 |
| Gastric ca.* (liver met) NCI-N87 | 0.0 | Melanoma M14 | 0.0 |
| Bladder | 0.0 | Melanoma LOX IMVI | 0.0 |
| Trachea | 90.8 | Melanoma* (met) SK-MEL-5 | 0.0 |
| Kidney | 0.5 | Adipose | 0.0 |

TABLE 51

Panel 2D

| Tissue Name | Rel. Exp. (%) Ag1799, Run 156251136 | Tissue Name | Rel. Exp. (%) Ag1799, Run 156251136 |
|---|---|---|---|
| Normal Colon | 0.0 | Kidney Margin 8120608 | 0.0 |
| CC Well to Mod Diff (ODO3866) | 0.0 | Kidney Cancer 8120613 | 0.0 |
| CC Margin (ODO3866) | 0.0 | Kidney Margin 8120614 | 0.0 |
| CC Gr.2 rectosigmoid (ODO3868) | 0.0 | Kidney Cancer 9010320 | 3.3 |
| CC Margin (ODO3868) | 0.0 | Kidney Margin 9010321 | 0.0 |
| CC Mod Diff (ODO3920) | 0.0 | Normal Uterus | 0.0 |
| CC Margin (ODO3920) | 0.0 | Uterus Cancer 064011 | 0.0 |
| CC Gr.2 ascend colon (ODO3921) | 0.0 | Normal Thyroid | 100.0 |
| CC Margin (ODO3921) | 0.0 | Thyroid Cancer 0604010 | 0.0 |
| CC from Partial Hepatectomy (ODO4309) Mets | 0.0 | Thyroid Cancer A302152 | 25.2 |
| Liver Margin (ODO4309) | 0.0 | Thyroid Margin A302153 | 46.3 |
| Colon mets to lung (OD04451-01) | 0.0 | Normal Breast | 0.0 |
| Lung Margin (OD04451-02) | 0.0 | Breast Cancer (OD04566) | 0.0 |
| Normal Prostate 6546-1 | 15.6 | Breast Cancer (OD04590-01) | 0.0 |
| Prostate Cancer (OD04410) | 0.0 | Breast Cancer Mets (OD04590-03) | 0.0 |
| Prostate Margin (OD04410) | 0.0 | Breast Cancer Metastasis (OD04655-05) | 0.0 |
| Prostate Cancer (OD04720-01) | 0.0 | Breast Cancer 064006 | 0.0 |

TABLE 51-continued

Panel 2D

| Tissue Name | Rel. Exp. (%) Ag1799, Run 156251136 | Tissue Name | Rel. Exp. (%) Ag1799, Run 156251136 |
|---|---|---|---|
| Prostate Margin (OD04720-02) | 9.7 | Breast Cancer 1024 | 0.0 |
| Normal Lung 061010 | 15.6 | Breast Cancer 9100266 | 0.0 |
| Lung Met to Muscle (ODO4286) | 0.0 | Breast Margin 9100265 | 7.3 |
| Muscle Margin (ODO4286) | 0.0 | Breast Cancer A209073 | 15.2 |
| Lung Malignant Cancer (OD03126) | 0.0 | Breast Margin A2090734 | 0.0 |
| Lung Margin (OD03126) | 16.6 | Normal Liver | 0.0 |
| Lung Cancer (OD04404) | 0.0 | Liver Cancer 064003 | 0.0 |
| Lung Margin (OD04404) | 0.0 | Liver Cancer 1025 | 0.0 |
| Lung Cancer (OD04565) | 0.0 | Liver Cancer 1026 | 0.0 |
| Lung Margin (OD04565) | 0.0 | Liver Cancer 6004-T | 0.0 |
| Lung Cancer (OD04237-01) | 8.5 | Liver Tissue 6004-N | 0.0 |
| Lung Margin (OD04237-02) | 0.0 | Liver Cancer 6005-T | 0.0 |
| Ocular Mel Met to Liver (ODO4310) | 8.1 | Liver Tissue 6005-N | 0.0 |
| Liver Margin (ODO4310) | 0.0 | Normal Bladder | 0.0 |
| Melanoma Mets to Lung (OD04321) | 15.8 | Bladder Cancer 1023 | 0.0 |
| Lung Margin (OD04321) | 0.0 | Bladder Cancer A302173 | 0.0 |
| Normal Kidney | 0.0 | Bladder Cancer (OD04718-01) | 0.0 |
| Kidney Ca, Nuclear grade 2 (OD04338) | 0.0 | Bladder Normal Adjacent (OD04718-03) | 0.0 |
| Kidney Margin (OD04338) | 0.0 | Normal Ovary | 6.8 |
| Kidney Ca Nuclear grade 1/2 (OD04339) | 0.0 | Ovarian Cancer 064008 | 0.0 |
| Kidney Margin (OD04339) | 0.0 | Ovarian Cancer (OD04768-07) | 0.0 |
| Kidney Ca, Clear cell type (OD04340) | 0.0 | Ovary Margin (OD04768-08) | 0.0 |
| Kidney Margin (OD04340) | 0.0 | Normal Stomach | 0.0 |
| Kidney Ca, Nuclear grade 3 (OD04348) | 0.0 | Gastric Cancer 9060358 | 0.0 |
| Kidney Margin (OD04348) | 0.0 | Stomach Margin 9060359 | 0.0 |
| Kidney Cancer (OD04622-01) | 0.0 | Gastric Cancer 9060395 | 5.6 |
| Kidney Margin (OD04622-03) | 0.0 | Stomach Margin 9060394 | 0.0 |
| Kidney Cancer (OD04450-01) | 0.0 | Gastric Cancer 9060397 | 0.0 |
| Kidney Margin (OD04450-03) | 0.0 | Stomach Margin 9060396 | 0.0 |
| Kidney Cancer 8120607 | 0.0 | Gastric Cancer 064005 | 0.0 |

TABLE 52

Panel 4D

| Tissue Name | Rel. Exp. (%) Ag1799, Run 156251137 | Tissue Name | Rel. Exp. (%) Ag1799, Run 156251137 |
|---|---|---|---|
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNFalpha + IFN gamma | 0.0 |
| Secondary Th1 rest | 0.0 | HUVEC TNFalpha + IL4 | 0.0 |
| Secondary Th2 rest | 0.0 | HUVEC IL-11 | 0.0 |

TABLE 52-continued

Panel 4D

| Tissue Name | Rel. Exp. (%) Ag1799, Run 156251137 | Tissue Name | Rel. Exp. (%) Ag1799, Run 156251137 |
|---|---|---|---|
| Secondary Tr1 rest | 0.0 | Lung Microvascular EC none | 0.0 |
| Primary Th1 act | 0.0 | Lung Microvascular EC TNFalpha + IL-1beta | 0.0 |
| Primary Th2 act | 0.0 | Microvascular Dermal EC none | 0.0 |
| Primary Tr1 act | 0.0 | Microsvasular Dermal EC TNFalpha + IL-1beta | 0.0 |
| Primary Th1 rest | 0.0 | Bronchial epithelium TNFalpha + IL1beta | 0.0 |
| Primary Th2 rest | 0.0 | Small airway epithelium none | 0.0 |
| Primary Tr1 rest | 0.0 | Small airway epithelium TNFalpha + IL-1beta | 0.0 |
| CD45RA CD4 lymphocyte act | 0.0 | Coronery artery SMC rest | 0.0 |
| CD45RO CD4 lymphocyte act | 0.0 | Coronery artery SMC TNFalpha + IL-1beta | 0.0 |
| CD8 lymphocyte act | 0.0 | Astrocytes rest | 0.0 |
| Secondary CD8 lymphocyte rest | 0.0 | Astrocytes TNFalpha + IL-1beta | 0.0 |
| Secondary CD8 lymphocyte act | 0.0 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 0.0 | CCD1106 (Keratinocytes) TNFalpha + IL-1beta | 0.0 |
| LAK cells IL-2 | 0.0 | Liver cirrhosis | 0.0 |
| LAK cells IL-2 + IL-12 | 0.0 | Lupus kidney | 0.0 |
| LAK cells IL-2 + IFN gamma | 0.0 | NCI-H292 none | 0.0 |
| LAK cells IL-2 + IL-18 | 0.0 | NCI-H292 IL-4 | 4.8 |
| LAK cells PMA/ionomycin | 0.0 | NCI-H292 IL-9 | 5.2 |
| NK Cells IL-2 rest | 0.0 | NCI-H292 IL-13 | 0.0 |
| Two Way MLR 3 day | 0.0 | NCI-H292 IFN gamma | 0.0 |
| Two Way MLR 5 day | 0.0 | HPAEC none | 0.0 |
| Two Way MLR 7 day | 0.0 | HPAEC TNFalpha + IL-1 beta | 0.0 |
| PBMC rest | 0.0 | Lung fibroblast none | 0.0 |
| PBMC PWM | 0.0 | Lung fibroblast TNFalpha + IL-1 beta | 0.0 |
| PBMC PHA-L | 0.0 | Lung fibroblast IL-4 | 0.0 |
| Ramos (B cell) none | 0.0 | Lung fibroblast IL-9 | 0.0 |
| Ramos (B cell) ionomycin | 0.0 | Lung fibroblast IL-13 | 0.0 |
| B lymphocytes PWM | 0.0 | Lung fibroblast IFN gamma | 0.0 |
| B lymphocytes CD40L and IL-4 | 0.0 | Dermal fibroblast CCD1070 rest | 0.0 |
| EOL-1 dbcAMP | 0.0 | Dermal fibroblast CCD1070 TNFalpha | 0.0 |
| EOL-1 dbcAMP PMA/ionomycin | 0.0 | Dermal fibroblast CCD1070 IL-1 beta | 0.0 |
| Dendritic cells none | 0.0 | Dermal fibroblast IFN gamma | 0.0 |
| Dendritic cells LPS | 0.0 | Dermal fibroblast IL-4 | 0.0 |
| Dendritic cells anti-CD40 | 0.0 | IBD Colitis 2 | 0.0 |
| Monocytes rest | 0.0 | IBD Crohn's | 0.0 |
| Monocytes LPS | 0.0 | Colon | 0.0 |
| Macrophages rest | 0.0 | Lung | 0.0 |
| Macrophages LPS | 0.0 | Thymus | 40.3 |
| HUVEC none | 0.0 | Kidney | 100.0 |
| HUVEC starved | 0.0 | | |

CNS_neurodegeneration_v1.0 Summary: Ag1799 Expression of the NOV6 gene is low/undetectable in all samples on this panel. (CTs>35). (Data not shown.) The amp plot indicates that there is a high probability of a probe failure.

Panel 1.3D Summary: Ag1799 Expression of the NOV6 gene is restricted to a few samples, with highest expression in the trachea and adrenal gland (CTs=31). Thus, expression of this gene could be used as a marker of these tissue types.

Panel 2D Summary: Ag1799 Expression of the NOV6 gene is restricted to a samples derived from thyroid (CT=33.5). Thus, expression of this gene could be used as a marker of thyroid tissue.

Panel 4D Summary: Ag1799 Expression of the NOV6 gene is restricted to a samples derived from thymus and kidney (CTs=33–34). Thus, expression of this gene could be used as a marker of these tissues.

Panel 5D Summary: Ag1799 Expression of the NOV6 gene is low/undetectable in all samples on this panel. (CTs>35). (Data not shown.) The amp plot indicates that there is a high probability of a probe failure.

NOV5

Expression of gene NOV5 was assessed using the primer-probe set Ag2911, described in Table 53. Results of the RTQ-PCR runs are shown in Table 54.

TABLE 53

Probe Name Ag2911

| Primers | Sequences | Length | Start Position | SEQ ID NO: |
|---|---|---|---|---|
| Forward | 5'-cagggatggaatgcattatg-3' | 20 | 349 | 191 |
| Probe | TET-5'-caatgtcacctgtactcagatctgtga-3'-TAMRA | 27 | 371 | 192 |
| Reverse | 5'-gctctccaaagcagtaaggaa-3' | 21 | 422 | 193 |

TABLE 54

Panel 1.3D

| Tissue Name | Rel. Exp. (%) Ag2911, Run 162292963 | Tissue Name | Rel. Exp. (%) Ag2911, Run 162292963 |
|---|---|---|---|
| Liver adenocarcinoma | 0.0 | Kidney (fetal) | 0.0 |
| Pancreas | 0.0 | Renal ca. 786-0 | 0.0 |
| Pancreatic ca. CAPAN 2 | 0.0 | Renal ca. A498 | 0.0 |
| Adrenal gland | 0.0 | Renal ca. RXF 393 | 0.0 |
| Thyroid | 0.0 | Renal ca. ACHN | 0.0 |
| Salivary gland | 0.0 | Renal ca. UO-31 | 0.0 |
| Pituitary gland | 0.0 | Renal ca. TK-10 | 0.0 |
| Brain (fetal) | 0.0 | Liver | 0.0 |
| Brain (whole) | 21.5 | Liver (fetal) | 0.0 |
| Brain (amygdala) | 15.8 | Liver ca. (hepatoblast) HepG2 | 0.0 |
| Brain (cerebellum) | 53.2 | Lung | 0.0 |
| Brain (hippocampus) | 10.5 | Lung (fetal) | 0.0 |
| Brain (substantia nigra) | 3.2 | Lung ca. (small cell) LX-1 | 0.0 |
| Brain (thalamus) | 0.0 | Lung ca. (small cell) NCI-H69 | 0.0 |
| Cerebral Cortex | 54.0 | Lung ca. (s.cell var.) SHP-77 | 12.4 |
| Spinal cord | 0.0 | Lung ca. (large cell)NCI-H460 | 3.8 |
| glio/astro U87-MG | 0.0 | Lung ca. (non-sm. cell) A549 | 0.0 |
| glio/astro U-118-MG | 0.0 | Lung ca. (non-s.cell) NCI-H23 | 0.0 |
| astrocytoma SW1783 | 2.7 | Lung ca. (non-s.cell) HOP-62 | 0.0 |
| neuro*; met SK-N-AS | 0.0 | Lung ca. (non-s.cl) NCI-H522 | 0.0 |
| astrocytoma SF-539 | 0.0 | Lung ca. (squam.) SW 900 | 0.0 |
| astrocytoma SNB-75 | 0.0 | Lung ca. (squam.) NCI-H596 | 0.0 |
| glioma SNB-19 | 0.0 | Mammary gland | 0.0 |
| glioma U251 | 0.0 | Breast ca.* (pl.ef) MCF-7 | 0.0 |
| glioma SF-295 | 0.0 | Breast ca.* (pl.ef) MDA-MB-231 | 0.0 |
| Heart (fetal) | 0.0 | Breast ca.* (pl.ef) T47D | 4.2 |
| Heart | 6.7 | Breast ca. BT-549 | 0.0 |
| Skeletal muscle (fetal) | 100.0 | Breast ca. MDA-N | 0.0 |

TABLE 54-continued

Panel 1.3D

| Tissue Name | Rel. Exp. (%) Ag2911, Run 162292963 | Tissue Name | Rel. Exp. (%) Ag2911, Run 162292963 |
| --- | --- | --- | --- |
| Skeletal muscle | 8.3 | Ovary | 0.0 |
| Bone marrow | 0.0 | Ovarian ca. OVCAR-3 | 3.4 |
| Thymus | 15.0 | Ovarian ca. OVCAR-4 | 0.0 |
| Spleen | 2.2 | Ovarian ca. OVCAR-5 | 0.0 |
| Lymph node | 0.0 | Ovarian ca. OVCAR-8 | 0.0 |
| Colorectal | 3.3 | Ovarian ca. IGROV-1 | 0.0 |
| Stomach | 0.0 | Ovarian ca.* (ascites) SK-OV-3 | 0.0 |
| Small intestine | 0.0 | Uterus | 2.5 |
| Colon ca. SW480 | 0.0 | Placenta | 0.0 |
| Colon ca.* SW620(SW480 met) | 0.0 | Prostate | 0.0 |
| Colon ca. HT29 | 0.0 | Prostate ca.* (bone met)PC-3 | 0.0 |
| Colon ca. HCT-116 | 0.0 | Testis | 6.7 |
| Colon ca. CaCo-2 | 0.0 | Melanoma Hs688(A).T | 12.9 |
| Colon ca. tissue(ODO3866) | 0.0 | Melanoma* (met) Hs688(B).T | 0.0 |
| Colon ca. HCC-2998 | 0.0 | Melanoma UACC-62 | 0.0 |
| Gastric ca.* (liver met) NCI-N87 | 0.0 | Melanoma M14 | 0.0 |
| Bladder | 1.8 | Melanoma LOX IMVI | 3.3 |
| Trachea | 3.4 | Melanoma* (met) SK-MEL-5 | 0.0 |
| Kidney | 0.0 | Adipose | 0.0 |

CNS_neurodegeneration_v1.0 Summary: Ag2911 Amp plot shows that there were experimental difficulties with this run and gene NOV5. (Data not shown.)

Panel 1.3D Summary: Ag2911 The NOV5 gene, a fatty acid binding homolog, appears to be differentially expressed in adult (CT value=34) vs fetal skeletal muscle (CT value=38). This gene product may be useful for the differentiation of the adult from the fetal source of this tissue. Fatty acid binding proteins sequester fatty acid moieties thereby protecting against intracellular lipotoxicity. Thus, an activator of this gene product may be a treatment for the prevention of lipotoxicity in skeletal muscle. Furthermore, increased intracellular triglyceride accumulation is considered to be pathogenically important in skeletal muscle insulin resistance and Type 2 diabetes. Thus, therapeutic modulation of the expression or function of this gene may be effective in the treatment of Type 2 diabetes.

REFERENCES

Unger R, Orci L. Diseases of liporegulation: new perspective on obesity and related disorders. FASEB J. 2001 February;15(2):312–21. Review.

Obesity-related diseases now threaten to reach epidemic proportions in the United States. Here we review in a rodent model of genetic obesity, the fa/fa Zucker diabetic fatty (ZDF) rat, the mechanisms involved in the most common complications of diet-induced human obesity, i.e., noninsulin-dependent diabetes mellitus, and myocardial dysfunction. In ZDF rats, hyperphagia leads to hyperinsulinemia, which up-regulates transcription factors that stimulate lipogenesis. This causes ectopic deposition of triacylglycerol in nonadipocytes, providing fatty acid (FA) substrate for damaging pathways of nonoxidative metabolism, such as ceramide synthesis. In beta cells and myocardium, the resulting functional impairment and apoptosis cause diabetes and cardiomyopathy. Interventions that lower ectopic lipid accumulation or block nonoxidative metabolism of FA and ceramide formation completely prevent these complications. Given the evidence for a similar etiology for the complications of human obesity, it would be appropriate to develop strategies to avert the predicted epidemic of lipotoxic disorders.

PMID: 11156947

Unger R, Orci L. Lipotoxic diseases of nonadipose tissues in obesity. Int J Obes Relat Metab Disord. 2000 November;24 Suppl 4:S28–32. Review.

It is proposed that an important function of leptin is to confine the storage of triglycerides (TG) to the adipocytes, while limiting TG storage in nonadipocytes. Excess TG deposition in nonadipocytes leads to impairment of functions, increased ceramide formation, which triggers nitric oxide-mediated lipotoxicity and lipoapoptosis. The fact that TG content in nonadipocytes normally remains within a very narrow range irrespective of excess caloric intake, while TG content of adipocytes rises, is consistent with a system of fatty acid (FA) homeostasis in nonadipose tissues. When leptin is deficient or leptin receptors are dysfunctional, TG content in nonadipose tissues such as pancreatic islets, heart and skeletal muscle, can increase 10–50-fold, suggesting that leptin controls the putative homeostatic system for intracellular TG. The fact that function and viability of nonadipocytes is compromised when their TG content rises above normal implies that normal homeostasis of their intracellular FA is critical for prevention of complications of obesity. FA overload of skeletal muscle, myocardium and pancreatic islets cause, respectively, insulin resistance, lipotoxic heart disease and adipogenic type 2 diabetes. All can be completely prevented by treatment with antisteatotic agents such as troglitazone. In diet-induced obesity, leptin signaling is normal initially and lipotoxic changes are at first prevented; later, however, post-receptor leptin resistance appears, leading to dysfunction and lipoapoptosis in nonadipose tissues, the familiar complications of obesity.

PMID: 11126236

Panel 2D Summary: Ag2911 Expression of gene NOV5 is low/undetectable in all samples on this panel (CTs>35). (Data not shown.)

Panel 4D Summary: Ag2911 Expression of gene NOV5 is low/undetectable in all samples on this panel (CTs>35). (Data not shown.)

NOV13

Expression of gene NOV13 was assessed using the primer-probe set Ag1559, described in Table 55. Results of the RTQ-PCR runs are shown in Table 56.

TABLE 55

Probe Name Ag1559

| Primers | Sequences | Length | Start Position | SEQ ID NO: |
|---|---|---|---|---|
| Forward | 5'-caggacctcggttatcaaca-3' | 20 | 406 | 194 |
| Probe | TET-5'-acctacgttgagcaaccgtgccg-3'-TAMRA | 23 | 426 | 195 |
| Reverse | 5'-atcgtactcgctggcgtaa-3' | 19 | 483 | 196 |

TABLE 56

Panel 5D

| Tissue Name | Rel. Exp. (%) Ag1559, Run 169269222 | Tissue Name | Rel. Exp. (%) Ag1559, Run 169269222 |
|---|---|---|---|
| 97457_Patient-02go_adipose | 0.0 | 94709_Donor 2 AM - A_adipose | 0.0 |
| 97476_Patient-07sk_skeletal muscle | 0.0 | 94710_Donor 2 AM - B_adipose | 0.0 |
| 97477_Patient-07ut_uterus | 0.0 | 94711_Donor 2 AM - C_adipose | 0.0 |
| 97478_Patient-07pl_placenta | 0.0 | 94712_Donor 2 AD - A_adipose | 0.0 |
| 97481_Patient-08sk_skeletal muscle | 0.0 | 94713_Donor 2 AD - B_adipose | 0.0 |
| 97482_Patient-08ut_uterus | 0.0 | 94714_Donor 2 AD - C_adipose | 0.0 |
| 97483_Patient-08pl_placenta | 0.0 | 94742_Donor 3 U - A_Mesenchymal Stem Cells | 0.0 |
| 97486_Patient-09sk_skeletal muscle | 0.0 | 94743_Donor 3 U - B_Mesenchymal Stem Cells | 0.0 |
| 97487_Patient-09ut_uterus | 100.0 | 94730_Donor 3 AM - A_adipose | 0.0 |
| 97488_Patient-09pl_placenta | 0.0 | 94731_Donor 3 AM - B_adipose | 0.0 |
| 97492_Patient-10ut_uterus | 0.0 | 94732_Donor 3 AM - C_adipose | 0.0 |
| 97493_Patient-10pl_placenta | 0.0 | 94733_Donor 3 AD - A_adipose | 0.0 |
| 97495_Patient-11go_adipose | 0.0 | 94734_Donor 3 AD - B_adipose | 0.0 |
| 97496_Patient-11sk_skeletal muscle | 0.0 | 94735_Donor 3 AD - C_adipose | 0.0 |
| 97497_Patient-11ut_uterus | 0.0 | 77138_Liver_HepG2untreated | 0.0 |
| 97498_Patient-11pl_placenta | 0.0 | 73556_Heart_Cardiac stromal cells (primary) | 0.0 |
| 97500_Patient-12go_adipose | 0.0 | 81735_Small Intestine | 0.0 |
| 97501_Patient-12sk_skeletal muscle | 0.0 | 72409_Kidney_Proximal Convoluted Tubule | 0.0 |
| 97502_Patient-12ut_uterus | 0.0 | 82685_Small intestine_Duodenum | 0.0 |
| 97503_Patient-12pl_placenta | 0.0 | 90650_Adrenal_Adrenocortical adenoma | 0.0 |
| 94721_Donor 2 U - A_Mesenchymal Stem Cells | 0.0 | 72410_Kidney_HRCE | 0.0 |
| 94722_Donor 2 U - B_Mesenchymal Stem Cells | 0.0 | 72411_Kidney_HRE | 0.0 |
| 94723_Donor 2 U - C_Mesenchymal Stem Cells | 0.0 | 73139_Uterus_Uterine smooth muscle cells | 0.0 |

Panel 1.3D Summary: Ag1559 Expression of the NOV13 gene is low/undetectable in all samples on this panel. (CTs>35). (Data not shown.) The data suggest that there was a possible probe failure.

Panel 2.2 Summary: Ag1559 Expression of the NOV13 gene is low/undetectable in all samples on this panel. (CTs>35). (Data not shown.) The data suggest that there was a possible probe failure.

Panel 5D Summary: Ag1559 Expression of the NOV13 gene is limited to placental tissue (CT=34.7). Thus, expression of this gene could be used as a marker for this tissue. Furthermore, this novel cytoplasmic protein may be important for the pathogenesis, diagnosis, and/or treatment of reproductive diseases.

Example 3

SNP Analysis of NOVX Clones

SeqCalling™ Technology: cDNA was derived from various human samples representing multiple tissue types, normal and diseased states, physiological states, and developmental states from different donors. Samples were obtained as whole tissue, cell lines, primary cells or tissue cultured primary cells and cell lines. Cells and cell lines may have been treated with biological or chemical agents that regulate gene expression for example, growth factors, chemokines, steroids. The cDNA thus derived was then sequenced using CuraGen's proprietary SeqCalling technology. Sequence traces were evaluated manually and edited for corrections if appropriate. cDNA sequences from all samples were assembled with themselves and with public ESTs using bioinformatics programs to generate CuraGen's human SeqCalling database of SeqCalling assemblies. Each assembly contains one or more overlapping cDNA sequences derived from one or more human samples. Fragments and ESTs were included as components for an assembly when the extent of identity with another component of the assembly was at least 95% over 50 bp. Each assembly can represent a gene and/or its variants such as splice forms and/or single nucleotide polymorphisms (SNPs) and their combinations.

Variant sequences are included in this application. A variant sequence can include a single nucleotide polymorphism (SNP). A SNP can, in some instances, be referred to as a "cSNP" to denote that the nucleotide sequence containing the SNP originates as a cDNA. A SNP can arise in several ways. For example, a SNP may be due to a substitution of one nucleotide for another at the polymorphic site. Such a substitution can be either a transition or a transversion. A SNP can also arise from a deletion of a nucleotide or an insertion of a nucleotide, relative to a reference allele. In this case, the polymorphic site is a site at which one allele bears a gap with respect to a particular nucleotide in another allele. SNPs occurring within genes may result in an alteration of the amino acid encoded by the gene at the position of the SNP. Intragenic SNPs may also be silent, however, in the case that a codon including a SNP encodes the same amino acid as a result of the redundancy of the genetic code. SNPs occurring outside the region of a gene, or in an intron within a gene, do not result in changes in any amino acid sequence of a protein but may result in altered regulation of the expression pattern for example, alteration in temporal expression, physiological response regulation, cell type expression regulation, intensity of expression, stability of transcribed message.

Method of novel SNP Identification: SNPs are identified by analyzing sequence assemblies using CuraGen's proprietary SNPTool algorithm. SNPTool identifies variation in assemblies with the following criteria: SNPs are not analyzed within 10 base pairs on both ends of an alignment; Window size (number of bases in a view) is 10; The allowed number of mismatches in a window is 2; Minimum SNP base quality (PHRED score) is 23; Minimum number of changes to score an SNP is 2/assembly position. SNPTool analyzes the assembly and displays SNP positions, associated individual variant sequences in the assembly, the depth of the assembly at that given position, the putative assembly allele frequency, and the SNP sequence variation. Sequence traces are then selected and brought into view for manual validation. The consensus assembly sequence is imported into CuraTools along with variant sequence changes to identify potential amino acid changes resulting from the SNP sequence variation. Comprehensive SNP data analysis is then exported into the SNPCalling database.

Method of novel SNP Confirmation: SNPs are confirmed employing a validated method know as Pyrosequencing (Pyrosequencing, Westborough, Mass.). Detailed protocols for Pyrosequencing can be found in: Alderbom et al. Determination of Single Nucleotide Polymorphisms by Real-time Pyrophosphate DNA Sequencing. (2000). Genome Research. 10, Issue 8, August. 1249–1265. In brief, Pyrosequencing is a real time primer extension process of genotyping. This protocol takes double-stranded, biotinylated PCR products from genomic DNA samples and binds them to streptavidin beads. These beads are then denatured producing single stranded bound DNA. SNPs are characterized utilizing a technique based on an indirect bioluminometric assay of pyrophosphate (PPi) that is released from each dNTP upon DNA chain elongation. Following Klenow polymerase-mediated base incorporation, PPi is released and used as a substrate, together with adenosine 5'-phosphosulfate (APS), for ATP sulfurylase, which results in the formation of ATP. Subsequently, the ATP accomplishes the conversion of luciferin to its oxi-derivative by the action of luciferase. The ensuing light output becomes proportional to the number of added bases, up to about four bases. To allow processivity of the method dNTP excess is degraded by apyrase, which is also present in the starting reaction mixture, so that only dNTPs are added to the template during the sequencing. The process has been fully automated and adapted to a 96-well format, which allows rapid screening of large SNP panels. The DNA and protein sequences for the novel single nucleotide polymorphic variants are reported. Variants are reported individually but any combination of all or a select subset of variants are also included. In addition, the positions of the variant bases and the variant amino acid residues are underlined.

Results

Variants are reported individually but any combination of all or a select subset of variants are also included as contemplated NOVX embodiments of the invention.

NOV2a SNP Data:

NOV2a has two SNP variants, whose variant positions for its nucleotide and amino acid sequences is numbered according to SEQ ID NOs:9 and 10, respectively. The nucleotide sequence of the NOV2a variant differs as shown in Table 57.

TABLE 57 cSNP and Coding Variants for NOV2a

| NT Position of cSNP | Wild Type NT | Variant NT | Amino Acid position | Amino Acid Change |
|---|---|---|---|---|
| 633 | A | G | 199 | E->G |
| 941 | G | A | 302 | G->S |
| 1156 | T | C | 373 | No change |

NOV2b SNP Data:

NOV2b has four SNP variants, whose variant positions for its nucleotide and amino acid sequences is numbered according to SEQ ID NOs:11 and 12, respectively. The nucleotide sequence of the NOV2b variant differs as shown in Table 58.

TABLE 58 cSNP and Coding Variants for NOV2b

| NT Position of cSNP | Wild Type NT | Variant NT | Depth | Putative Allele Freq. |
|---|---|---|---|---|
| 635 | G | A | 37 | 0.216 |
| 786 | C | T | 43 | 0.047 |
| 948 | A | G | 37 | 0.162 |
| 1119 | T | C | 26 | 0.231 |

NOV2c SNP Data:

NOV2c has four SNP variants, whose variant positions for its nucleotide and amino acid sequences is numbered according to SEQ ID NOs:13 and 14, respectively. The nucleotide sequence of the NOV2c variant differs as shown in Table 59.

TABLE 59 cSNP and Coding Variants for NOV2c

| NT Position of cSNP | Wild Type NT | Variant NT | Depth | Putative Allele Freq. |
|---|---|---|---|---|
| 149 | A | G | 16 | 0.375 |
| 174 | T | C | 16 | 0.125 |
| 175 | T | C | 16 | 0.125 |
| 320 | C | T | 15 | 0.467 |
| 386 | T | C | 15 | 0.133 |
| 435 | G | A | 16 | 0.125 |

NOV6 SNP Data:

NOV6 has one SNP variant, whose variant position for its nucleotide and amino acid sequences is numbered according to SEQ ID NOs:25 and 26, respectively. The nucleotide sequence of the NOV6 variant differs as shown in Table 60.

TABLE 60 cSNP and Coding Variants for NOV6

| NT Position of cSNP | Wild Type NT | Variant NT | Amino Acid position | Amino Acid Change |
|---|---|---|---|---|
| 190 | G | S | 64 | A->T |
| 396 | A | G | 132 | No change |

NOV7a SNP data:

NOV7a has one SNP variant, whose variant position for its nucleotide and amino acid sequences is numbered according to SEQ ID NOs:27 and 28, respectively. The nucleotide sequence of the NOV7a variant differs as shown in Table 61.

TABLE 61 cSNP and Coding Variants for NOV7a

| NT Position of cSNP | Wild Type NT | Variant NT | Amino Acid position | Amino Acid Change |
|---|---|---|---|---|
| 1638 | C | T | 513 | P->L |

NOV8 SNP data:

NOV8 has one SNP variant, whose variant position for its nucleotide and amino acid sequences is numbered according to SEQ ID NOs:31 and 32, respectively. The nucleotide sequence of the NOV8 variant differs as shown in Table 62.

TABLE 62 cSNP and Coding Variants for NOV8

| NT Position of cSNP | Wild Type NT | Variant NT | Amino Acid position | Amino Acid Change |
|---|---|---|---|---|
| 102 | T | C | 28 | C->R |
| 185 | A | G | 55 | No change |
| 210 | G | A | 64 | A->T |
| 225 | T | C | 69 | F->L |
| 395 | T | C | 125 | No change |

Example 4

In-frame Cloning

NOV2e

For NOV2e the cDNA coding for the DOMAIN of NOV1 a from residues 51 to 400 was targeted for "in-frame" cloning by PCR. The PCR template was based on the previously identified plasmid, when available, or on human cDNA(s).

TABLE 99

Oligonucleotide primers used to clone the target cDNA sequence:

| Primers | Sequences | |
|---|---|---|
| F1 | 5'-GGATCC TCCCAGTTGGAGGAGGTGTTTCACTCT-3' | (SEQ ID NO:199) |
| R1 | 5'-CTCGAG AGGAGAAGAAAATCTGCCGAAGAAGAGGATGC-3' | (SEQ ID NO:200) |
| SF1 | 5'-ATGAACTGAACATAACCAACAGGCT-3' | (SEQ ID NO:201) |

TABLE 99-continued

Oligonucleotide primers used to clone the target cDNA sequence:

| Primers | Sequences | |
|---|---|---|
| SF2 | 5'-GGACTTGTTCCCAGATGGCTCTA-3' | (SEQ ID NO:202) |
| SF3 | 5'-TTTAGCTTCACTTTCCTGGAGGACT-3' | (SEQ ID NO:203) |
| SF4 | 5'-AAAGAAAGGTGAATCTGCACTTGCCC-3' | (SEQ ID NO:204) |
| SF5 | 5'-TTGTGGCAGTAACTGAGGAAGGC-3' | (SEQ ID NO:205) |
| SR1 | 5'-AGCCTGTTGGTTATGTTCAGTTCAT-3' | (SEQ ID NO:206) |
| SR2 | 5'-TTTTTCATTTGTTTTGCTTTCAACC-3' | (SEQ ID NO:207) |
| SR3 | 5'-AGGAATGGCTCTGTGTCATCATCTG-3' | (SEQ ID NO:209) |
| SR4 | 5'-CTTTCTTCCATATGCCCTGGACTA-3' | (SEQ ID NO:210) |
| SR5 | 5'-CAAAGGAACTGTGCAGGAACTTCT-3' | (SEQ ID NO:211) |

For downstream cloning purposes, the forward primer includes an in-frame Hind III restriction site and the reverse primer contains an in-frame Xho I restriction site.

Two parallel PCR reactions were set up using a total of 0.5–1.0 ng human pooled cDNAs as template for each reaction. The pool is composed of 5 micrograms of each of the following human tissue cDNAs: adrenal gland, whole brain, amygdala, cerebellum, thalamus, bone marrow, fetal brain, fetal kidney, fetal liver, fetal lung, heart, kidney, liver, lymphoma, Burkitts Raji cell line, mammary gland, pancreas, pituitary gland, placenta, prostate, salivary gland, skeletal muscle, small Intestine, spleen, stomach, thyroid, trachea, uterus.

When the tissue of expression is known and available, the second PCR was performed using the above primers and 0.5 ng–1.0 ng of one of the following human tissue cDNAs:

skeleton muscle, testis, mammary gland, adrenal gland, ovary, colon, normal cerebellum, normal adipose, normal skin, bone marrow, brain amygdala, brain hippocampus, brain substantia nigra, brain thalamus, thyroid, fetal lung, fetal liver, fetal brain, kidney, heart, spleen, uterus, pituitary gland, lymph node, salivary gland, small intestine, prostate, placenta, spinal cord, peripheral blood, trachea, stomach, pancreas, hypothalamus.

The reaction mixtures contained 2 microliters of each of the primers (original concentration: 5 pmol/ul), 1 microliter of 10 mM DNTP (Clontech Laboratories, Palo Alto Calif.) and 1 microliter of 50× Advantage-HF 2 polymerase (Clontech Laboratories) in 50 microliter-reaction volume. The following reaction conditions were used:

PCR condition 1:

| a) | 96° C. | 3 minutes |
|---|---|---|
| b) | 96° C. | 30 seconds denaturation |
| c) | 60° C. | 30 seconds, primer annealing |
| d) | 72° C. | 6 minutes extension |
| | | Repeat steps b–d 15 times |
| e) | 96° C. | 15 seconds denaturation |
| f) | 60° C. | 30 seconds, primer annealing |
| g) | 72° C. | 6 minutes extension |

-continued

| | | Repeat steps e–g 29 times |
|---|---|---|
| e) | 72° C. | 10 minutes final extension |

PCR condition 2:

| a) | 96° C. | 3 minutes |
|---|---|---|
| b) | 96° C. | 15 seconds denaturation |
| c) | 76° C. | 30 seconds, primer annealing, reducing the temperature by 1° C. per cycle |
| d) | 72° C. | 4 minutes extension |
| | | Repeat steps b–d 34 times |
| e) | 72° C. | 10 minutes final extension |

An amplified product was detected by agarose gel electrophoresis. The fragment was gel-purified and ligated into the pCR2.1 vector (Invitrogen, Carlsbad, Calif.) following the manufacturer's recommendation. Twelve clones per PCR reaction were picked and sequenced. The inserts were sequenced using vector-specific M13 Forward and M13 Reverse primers and the gene-specific primers in Tables 88 and 89.

TABLE 88

Gene-specific Primers

| NOV | Primers | Sequences | |
|---|---|---|---|
| NOV11c | SF1 | GCCCTCCCGGTCCAGGTC | (SEQ ID NO:217) |
| | SF2 | GGCGACGGCACCAGCATGT | (SEQ ID NO:218) |
| | SR1 | GCCTGGCCTGCCGGGTTCT | (SEQ ID NO:219) |
| | SR2 | CATGAGCACGTGGTAAGCG | (SEQ ID NO:220) |

TABLE 89

Gene-specific Primers

| NOV | Primers | Sequences | |
|---|---|---|---|
| NOV1b | SF1 | GTGCTGGCATTGGAGTGTTTAGTG | (SEQ ID NO:221) |
| | SF2 | ATCAAGCACGTTGACACAGAATGAG | (SEQ ID NO:222) |
| | SF3 | GCATTCACTAACCTAACACCATTTACA | (SEQ ID NO:223) |
| | SF4 | GTTCAGCAGAGATCTGGTCTGACCTTC | (SEQ ID NO:224) |
| | SF5 | GGGATCCTCCAGATCCTGTATTTTT | (SEQ ID NO:208) |
| | SF6 | TGAAGAACACATCAACAACAGACATAA | (SEQ ID NO:225) |
| | SR1 | ACTGTTTTCAGCAGCTACCTTAATTTC | (SEQ ID NO:226) |
| | SR2 | CTTGATGAATGTGTGGTACGCGAT | (SEQ ID NO:227) |
| | SR3 | GTGAATGCAAACTTGAGGTCTTTTGT | (SEQ ID NO:212) |
| | SR4 | CCTCATATAATCCTACCATTGGCTGTACT | (SEQ ID NO:213) |
| | SR5 | GAGGATCCCAGTGTAAAAATACTTCTG | (SEQ ID NO:214) |
| | SR6 | TAGCACTTCATAAGCAATAATGATCCC | (SEQ ID NO:215) |
| | SR7 | TGAGTGTACTAGCAGACACCTCAATGAT | (SEQ ID NO:216) |

OTHER EMBODIMENTS

Although particular embodiments have been disclosed herein in detail, this has been done by way of example for purposes of illustration only, and is not intended to be limiting with respect to the scope of the appended claims, which follow. In particular, it is contemplated by the inventors that various substitutions, alterations, and modifications may be made to the invention without departing from the spirit and scope of the invention as defined by the claims. The choice of nucleic acid starting material, clone of interest, or library type is believed to be a matter of routine for a person of ordinary skill in the art with knowledge of the embodiments described herein. Other aspects, advantages, and modifications considered to be within the scope of the following claims.

SEQUENCE LISTING (227 sequences)

SEQ ID NO: 1 - DNA, 10809 bp, Homo sapiens
atggcgaagcggctctgcgcggggagcgcactgtgtgttcgcggcccccggggccccgcgccgctgctgctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccagggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgccgcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtgtgagtgctacggccatgccaccgactgttactacgaccctgaggtggaccggcgccgcgccagccagagcctggatggcacctatcagggtgggggtgtctgtatcgactgccagcaccacaccaccggcgtcaactgtgagcgctgcctgcccggcttctaccgctctcccaaccaccctctcgactcgccccacgtctgccgcggctgcaactgcgagtccgacttcacggatggcacctgcgaggacctgacgggtcgatgctactgccggcccaacttctctggggagcggtgtgacgtgtgtgccgagggcttcacgggcttcccaagctgctaccgtgagcacctgccagggaatgacaccagggagcaggtgctgccagccggccagattgtgagttgtgactgcagcgcggcagggacccagggcaacgcctgccggaaggacccaagggtgggacgctgtctgtgcaaacccaacttccaaggcacccattgtgagctctgcgcgccagggttctacggccccggctgccctgccagtgttccagccctggagtggccgatgaccgctgtgaccctgacacaggccagtgcaggtgccgagtgggcttcgagggggccacatgtgatcgctgtgcccccggctactttcacttccctctctgccagtcacccgctccgctctgcagtgtgtggctgcagccctgcaggaaccttgcccgagggctgcgatgaggccggccgctgcctatgccagcctgagtttgctggacctcattgtgaccggtgccgccctggctaccatggtttccccaactgcgcagcatgcacctgcgaccctcggggagccctggaccagctctgtggggcgggaggtttgtgccgctgccgccccggctacacaggcactgcctgccaggaatgcagccccggctttcacggcttccccagctgtcctgccactgctctgctgaaggctccctgcacgcagcctgtgacccccggagtgggcagtgcagctgccggccccgtgcggggctgcggtgtgacacatgtgtgcccggtgcctacaacttcccctactgcgaagcctctcttcacagctggctcttgccaccctgccggtctggccccagtggatcctgcccttcctgaggtgagcccaccctgtatgtgccgggctcacgtggaggggccgagctgtgaccgctgcaaacctgggttctggggactgagccccagcaaccccgagggctgtacccgttgcagctgcgacctcaggggcacactgggtggagttgctgagtgccagggcaccggccagtgcttctgcaagccccacgtgtgcggccaggcctgcgcgtcctgcaaggatggcttctttggactggatcaggctgactattttggctgccgcagttgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgtacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctccccccagctgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgaacaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggtcacgccaacgccagcttctgtccacatggctacggctgccgcaccctggtggtgtgtgagggccaggccctgctggacgtgacccacagcgagctcactgtgaccgtgcgtgtgcccaagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcagggcctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaggtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtaagctcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagacgcgcaacactgtgtcccgcgaggagctcatgatggtgctggccagcctggagcagctgcagatccgtgccctcttctcacagatctcctcggctgtcttcctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtgtgccagcacaacaccgaaggggcccactgtgagcgctgccaggctggcttcgtgagcagcagggacgaccccagcgccccctgtgtcagctgcccctgccccctctcagtgccttccaacaggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccgttgcgactgtaccccatgtgggacagaggcctgcgacccccacagcgggcactgcctgtgcaaggcgggcgtgactgggcggcgctgtgaccgctgccaggagggacattttggtttcgatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgttgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcaggtactgagcgtcctggccttccctccccaacccgggccagtgcaggccttcacctttcgcctcccacagagccagctccggagccccctgggcccccgccatgagacggcacagcagctggaggtgctggagcagcagagcacaagccttcctccacaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagagtgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctggaggggctaagtccactcaaattccaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtggcagacggtggtgcggcagggcctggtggaccgagcccagcagctcctggccaacagcactgcactagaagaggccatgctccaggaacagcagaggctgggccttggtgagtgctgggctccgatgggggcccttaggcctgctgggacccagctccgagatgtccgggccaagaaggaccagctggaggcgcacatccaggcggcgcaggccatgcttgccatggacacaggtgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggctctgcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccggtccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggtgagacctcaccaggtgtccctgcagcagggccgtgtgagcctacagctcctgaggactgaagtgaaaactcaagcgggcttcgccgatggtgccccccattacgtcgccttctacagcaatgccacgggggtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagacaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaacgtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttaggtctgccaggagctacactgcctgatgtgggcctggaactggaggtgcggcccctggcagtcaccggactgatcttccacttgggccaggcccggacgcccccctacttgcagttgcaggtgctaccccgccaggtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctagaataaa

SEQ ID NO: 2 - protein, 3600 aa, Homo sapiens
MAKRLCAGSALCVRGPRGPAPLLLHPPYFNLAEGARIAASATCGEEAPARGSPRPTEDLYCKLVGGPVAGGDPNQTIQGQYCDICTAANSNKAHPASNAIDGTERWWQSPPLSRGLEYNEVNVTLDLGQVFHVAYVLIKFANSPRPDLWVLERSMDFGRTYQPWQFFAASKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQCECYGHATDCYYDPEVDRRRASQSLDGTYQGGGVCIDCQHHTTGVNCERCLPGFYRSPNHPLDSPHVCRGCNCESDFTDGTCEDLTGRCYCRPNFSGERCDVCAEGFTGFPSCYREHLPGNDTREQVLPAGQIVSCDCSAAGTQGNACRKDPRVGRCLCKPNFQGTHCELCAPGFYGPGCPASVPALEWPMTAVTLTQASAGAEWASRGPHVIAVPPATFTSLSASHPLRSAVCGCSPAGTLPEGCDEAGRCLCQPEFAGPHCDRCRPGYHGFPNCAACTCDPRGALDQLCGAGGLCRCRPGYTGTACQECSPGFHGFPSCPATALLKAPCTQPVTPGVGSAAAGPVRGCGVTHVCPVPTTSPTAKPLFTAGSCHPAGLAPVDPALPEVSPPCMCRAHVEGPSCDRCKPGFWGLSPSNPEGCTRCSCDLRGTLGGVAECQGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSPPSCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPKGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRACDCGARLCDELTGQCICPPRTIPPDCLLCQPQTFGCHPLVGCEECNCSGPGIQELTDPTCDTDSGQCRCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVFLRRVALEVASPAGQGALASNVELCLCPASYRGDSCQECAPGFYRDVKGLFLGRCVPCQCHGHSDRCLPGSGVCVCQHNTEGAHCERCQAGFVSSRDDPSAPCVSCPCPLSVPSNRCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFDGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQVLSVLAFPPQPGPVQAFTFRLPQSQLRSPLGPRHETAQQLEVLEQQSTSLPPQAVGTRDQASQLLAGTEATLGHAKTLLAAIRAVDRTLSELMSQTGHLGLANASAPSGEQLLRTLAEVERLLWEMRARDLGAPQAAAEAELAAAQRVLARVQEQLSSLWEENQALATQTRDRLAQHEAGLMDLREALNRAVDATREAQELNSRNQERLEEALQRKQELSRDNATLQATLHAARDTLASVFRLLEGLSPLKFQELERLAASLDGARTPLLQRMQTFSPAGSKLRLVEAAEAHAQQLGQLALNLSIILDVNQDRLTQRAIEASNAYSRILQAVQAAEDAAGQALQQADHTWQTVVRQGLVDRAQQLLANSTALEEAMLQEQQRLGLGECWAPMGALRPAGTQLRDVRAKKDQLEAHIQAAQAMLAMDTGETSKKIAHAKAVAAEAQDTATRVQSQLQAMQENVERWQGQYEGLRGQDLGQAVLDAGSAVSTLEKTLPQLLAKLSILENRGVHNASLALSASIGRVRELIAQARGAASKVVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPSLRRLFPTGGSVRGCVKGIKALGKYVDLKRLNTTGVSAGCTADLLVGRAMTFHGHGFLRLALSNVAPLTGNVYSGFGFHSAQDSALLYYRASPVRPHQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRQASRRSRQPARHPACMLPPHLRTTRDSYQFGGSLSSHLEFVGILARHRNVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLGLPGATLPDVGLELEVRPLAVTGLIFHLGQARTPPYLQLQVLPRQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 3 - DNA, 3126 bp, Homo sapiens
tcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaaaaaaaaaa

SEQ ID NO: 4 - protein, 908 aa, Homo sapiens
MYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 5 - DNA, 10800 bp, Homo sapiens
atggcgaagcggctctgcgcggggagcgcactgtgtgttcgcggcccccggggccccgcgccgctgctgctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccagggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgccgcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtgtgagtgctacggccatgccaccgactgttactacgaccctgaggtggaccggcgccgcgccagccagagcctggatggcacctatcagggtgggggtgtctgtatcgactgccagcaccacaccaccggcgtcaactgtgagcgctgcctgcccggcttctaccgctctcccaaccaccctctcgactcgccccacgtctgccgcggctgcaactgcgagtccgacttcacggatggcacctgcgaggacctgacgggtcgatgctactgccggcccaacttctctggggagcggtgtgacgtgtgtgccgagggcttcacgggcttcccaagctgctaccgtgagcacctgccagggaatgacaccagggagcaggtgctgccagccggccagattgtgagttgtgactgcagcgcggcagggacccagggcaacgcctgccggaaggacccaagggtgggacgctgtctgtgcaaacccaacttccaaggcacccattgtgagctctgcgcgccagggttctacggccccggctgccctgccagtgttccagccctggagtggccgatgaccgctgtgaccctgacacaggccagtgcaggtgccgagtgggcttcgagggggccacatgtgatcgctgtgcccccggctactttcacttccctctctgccagtcacccgctccgctctgcagtgtgtggctgcagccctgcaggaaccttgcccgagggctgcgatgaggccggccgctgcctatgccagcctgagtttgctggacctcattgtgaccggtgccgccctggctaccatggtttccccaactgcgcagcatgcacctgcgaccctcggggagccctggaccagctctgtggggcgggaggtttgtgccgctgccgccccggctacacaggcactgcctgccaggaatgcagccccggctttcacggcttccccagctgtcctgccactgctctgctgaaggctccctgcacgcagcctgtgacccccggagtgggcagtgcagctgccggccccgtgcggggctgcggtgtgacacgtgtgtgcccggtgcctacaacttcccctactgcgaagctggctcttgccaccctgccggtctggcccccagtggatcctgcccttcctgaggcacaggttccctgtatgtgccgggctcacgtggaggggccgagctgtgaccgctgcaaacctgggttctggggactgagccccagcaaccccgaaggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccccgaccttttctggctcgtcttccgatacgtcaaccggggggccatgagtgtgagcgggcgggtctctgtgcgagaggagggcaggtcggccgcctgtgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctccccccagctgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgaacaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggtcacgccaacgccagcttctgtccacatggctacggctgccgcaccctggtggtgtgtgagggccaggccctgctggacgtgacccacagcgagctcactgtgaccgtgcgtgtgcccaagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcagggcctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaggtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtaagctcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagacgcgcaacactgtgtcccgcgaggagctcatgatggtgctggccagcctggagcagctgcagatccgtgccctcttctcacagatctcctcggctgtcttcctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtgtgccagcacaacaccgaaggggcccactgtgagcgctgccaggctggcttcgtgagcagcagggacgaccccagcgccccctgtgtcagctgcccctgccccctctcagtgccttccaacaggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccgttgcgactgtaccccatgtgggacagaggcctgcgacccccacagcgggcactgcctgtgcaaggcgggcgtgactgggcggcgctgtgaccgctgccaggagggacattttggtttcgatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgttgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcaggtactgagcgtcctggccttccctccccaacccgggccagtgcaggccttcacctttcgcctcccacagagccagctccggagccccctgggcccccgccatgagacggcacagcagctggaggtgctggagcagcagagcacaagccttcctccacaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagagtgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctggaggggctaagtccactcaaattccaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtggcagacggtggtgcggcagggcctggtggaccgagcccagcagctcctggccaacagcactgcactagaagaggccatgctccaggaacagcagaggctgggccttggtgagtgctgggctccgatgggggcccttaggcctgctgggacccagctccgagatgtccgggccaagaaggaccagctggaggcgcacatccaggcggcgcaggccatgcttgccatggacacaggtgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggctctgcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccggtccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggtgagacctcaccaggtgtccctgcagcagggccgtgtgagcctacagctcctgaggactgaagtgaaaactcaagcgggcttcgccgatggtgccccccattacgtcgccttctacagcaatgccacgggggtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagacaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaacgtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttaggtctgccaggagctacactgcctgatgtgggcctggaactggaggtgcggcccctggcagtcaccggactgatcttccacttgggccaggcccggacgcccccctacttgcagttgcaggtgctaccccgccaggtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctagaataaa

SEQ ID NO: 6 - protein, 3597 aa, Homo sapiens
MAKRLCAGSALCVRGPRGPAPLLLHPPYFNLAEGARIAASATCGEEAPARGSPRPTEDLYCKLVGGPVAGGDPNQTIQGQYCDICTAANSNKAHPASNAIDGTERWWQSPPLSRGLEYNEVNVTLDLGQVFHVAYVLIKFANSPRPDLWVLERSMDFGRTYQPWQFFAASKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQCECYGHATDCYYDPEVDRRRASQSLDGTYQGGGVCIDCQHHTTGVNCERCLPGFYRSPNHPLDSPHVCRGCNCESDFTDGTCEDLTGRCYCRPNFSGERCDVCAEGFTGFPSCYREHLPGNDTREQVLPAGQIVSCDCSAAGTQGNACRKDPRVGRCLCKPNFQGTHCELCAPGFYGPGCPASVPALEWPMTAVTLTQASAGAEWASRGPHVIAVPPATFTSLSASHPLRSAVCGCSPAGTLPEGCDEAGRCLCQPEFAGPHCDRCRPGYHGFPNCAACTCDPRGALDQLCGAGGLCRCRPGYTGTACQECSPGFHGFPSCPATALLKAPCTQPVTPGVGSAAAGPVRGCGVTRVCPVPTTSPTAKLALATLPVWPPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSAACANCTAQSQPVAFPPSTEPAFITVPQRGFGEPFVLNPGTWALRVEAEGVLLDYVVLLPSAYYEAALLQLRVTEACTYRPSAQQSPPSCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPKGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRACDCGARLCDELTGQCICPPRTIPPDCLLCQPQTFGCHPLVGCEECNCSGPGIQELTDPTCDTDSGQCRCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVFLRRVALEVASPAGQGALASNVELCLCPASYRGDSCQECAPGFYRDVKGLFLGRCVPCQCHGHSDRCLPGSGVCVCQHNTEGAHCERCQAGFVSSRDDPSAPCVSCPCPLSVPSNRCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFDGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQVLSVLAFPPQPGPVQAFTFRLPQSQLRSPLGPRHETAQQLEVLEQQSTSLPPQAVGTRDQASQLLAGTEATLGHAKTLLAAIRAVDRTLSELMSQTGHLGLANASAPSGEQLLRTLAEVERLLWEMRARDLGAPQAAAEAELAAAQRVLARVQEQLSSLWEENQALATQTRDRLAQHEAGLMDLREALNRAVDATREAQELNSRNQERLEEALQRKQELSRDNATLQATLHAARDTLASVFRLLEGLSPLKFQELERLAASLDGARTPLLQRMQTFSPAGSKLRLVEAAEAHAQQLGQLALNLSIILDVNQDRLTQRAIEASNAYSRILQAVQAAEDAAGQALQQADHTWQTVVRQGLVDRAQQLLANSTALEEAMLQEQQRLGLGECWAPMGALRPAGTQLRDVRAKKDQLEAHIQAAQAMLAMDTGETSKKIAHAKAVAAEAQDTATRVQSQLQAMQENVERWQGQYEGLRGQDLGQAVLDAGSAVSTLEKTLPQLLAKLSILENRGVHNASLALSASIGRVRELIAQARGAASKVVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPSLRRLFPTGGSVRGCVKGIKALGKYVDLKRLNTTGVSAGCTADLLVGRAMTFHGHGFLRLALSNVAPLTGNVYSGFGFHSAQDSALLYYRASPVRPHQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRQASRRSRQPARHPACMLPPHLRTTRDSYQFGGSLSSHLEFVGILARHRNVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLGLPGATLPDVGLELEVRPLAVTGLIFHLGQARTPPYLQLQVLPRQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 7 - DNA, 5204 bp, Homo sapiens
gctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggacggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaaaaaaaaaa

SEQ ID NO: 8 - protein, 1640 aa, Homo sapiens
CDRCQEGHFGFNGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 9 - DNA, 3105 bp, Homo sapiens
tgttgttcttgctattctaggtctcgctaaaatcatcatggattcacttggcgccgtcagcactcgacttgggtttgatcttttcaaagagctgaagaaaacaaatgatggcaacatcttcttttcccctgtgggcatcttaactgcaattggcatggtcctcctggggacccgaggagccaccgcttcccagttggaggaggtgtttcactctgaaaaagagacgaagagctcaagaataaaggctgaagaaaaagaggtggtaagaataaaggctgaaggaaaagagattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttttttgtgccatgcgtaaggtgagtcaaaccaaacctcattgataatctcccctttggtttcctttgaaagtaaattggtatcttgtagttttgtgcacacgaaaggagagaaagtttctccagtaaagagtacgaactagtaattttggggggtctctctaattctggtattttgacatgttataatacgcaagtaaaataaaacaatagtttactcagctcatgttactattccccaacagatattgtggcaaatcacacataggaaagaggatttgggaatacagtagcaaaacataaattaaaactcaaatgcccaggacaaaataaaacaatataccagatggagaggatgcccgtattttcatcttccattctaacattatccattgttagatgcataagcattttgatattgtgtaataaatgtggtatttgagaagataaatgatgtagttgatcagtaatcctcctctatcacctttttagactttgtaaggtaaatatttggactaacttttagaaaagtttccctttttttctccatttacatttttctggtttttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaattttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaggatttttttattgccgaatactattccattgcatggaaaagacctattttatttctaggttcaccagttgagggacatttggattgttcccacttcttgggctgttaggaataatgttgctctgaacatgtaaataaagatctttgtgttcacatatgtttttcattttctgttggggagattccctaggctagaaattgctgggccatatgaaaaatcaatagttagctttgtaagaaacagtcaaactgttttcccaacgtgacattttatattcccaccaggaatgtttaaaactagtgtcttcaaatcctcaccaacatccaggattgtgtctttatgattatagccatttttgtaggtacaaagtggcatctcatggtggttttaatttgcatttccataatatctaattaggttgagctttttttatgtgcttattggccatttgtttgactttgtttggtgaaatgtatacaaatcatttgctcatttttaatttgggttgtctgtcttgtcttctcattttattgagttaaatgagttcttaataatctctggcttacaagtccttaatttatcaaatatatgatacgtggacatttcctcataaaaaaaaaaaaaaaaaa

SEQ ID NO: 10 - protein, 400 aa, Homo sapiens
MDSLGAVSTRLGFDLFKELKKTNDGNIFFSPVGILTAIGMVLLGTRGATASQLEEVFHSEKETKSSRIKAEEKEVVRIKAEGKEIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 11 - DNA, 1238 bp, Homo sapiens
ttctaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtggtaagaataaaggctgaaggaaaagagattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggggtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacagttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccactggcataggctttactgtcacatccgccccaggtcatgaaaatgttcactgcaatcatcccttcctgttcttcatcaggcacaatgaatccaacagcatcctcttcttcggcagattttcttctccttaagatgatcgttgc

SEQ ID NO: 12 - protein, 400 aa, Homo sapiens
MDSLGAVSTRLGFDLFKELKKTNDGNIFFSPVGILTAIGMVLLGTRGATASQLEEVFHSEKETKSSRIKAEEKEVVRIKAEGKEIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDRGFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDSYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 13 - DNA, 1559 bp, Homo sapiens
aagcttccatgaagaggaggctgtggagaggcagagacaggcagggtcagacagagagcaagagaataaagccattaaaacattaaccctgctccgcggggaaataagaactgagcaccaccggatgacggaagactccagtagattgatggatgtctcccagcaagagaaggccaagagaggacgtgagaagcaggcagcagcgacctttcaccaaaagggtggaaatccctgtattccggatcgatgcaagaagaggaatagaagcagaaaggattcccctgacacagagtaattcaaatgttcagttttgattgttgttcttgctattctaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtggtaagaataaaggctgaaggaaaagagattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacagttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccactggcataggctttactgtcacatccgccccaggtcatgaaaatgttcactgcaatcatcccttcctgttcttcatcaggcacaatgaatccaacagcatcctcttcttcggcagattttcttctccttaagatg

SEQ ID NO: 14 - protein, 400 aa, Homo sapiens [sequence omitted]

SEQ ID NO: 15 - DNA, 818 bp, Homo sapiens
accgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtggtaagaataaaggctgaaggaaaagagattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgatgtggaaactgaggcacagagagtttaaataacttgcccaagattcctcagctgataagaggcaaactggatgctaacagaggcatctgaccccagagtctggactcttaaccatgaaccttaatttatccactgggataaataggcgatgggcaaaatgagaacctccccgtcgattctgccagcaaaccctttgtcagcaaggccctcagaaaaaatcaaggacttgttcccagatggctctattagtagctctaccaagctggtgctggtgacatg

SEQ ID NO: 16 - protein, 175 aa, Homo sapiens
MDSLGAVSTRLGFDLFKELKKTNDGNIFFSPVGILTAIGMVLLGTRGATASQLEEVFHSEKETKSSRIKAEEKEVVRIKAEGKEIENTEAVHQQFQKFLTEISKLTNDYELNITNRLFGEKTYLFLQKYLDYVEKYYHASLEPVDFVNAADESRKKINSWVESKTNDVETEAQRV

SEQ ID NO: 17 - DNA, 5316 bp, Homo sapiens
gaattcggcacgaggtcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctggggcagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagttgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctatcgccagaaccgcttccccgtggtctgctggcgcagcgagcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgaggccctccctatgactgggaactggcccaggggccccctgaacccccagaggaagaacggtctgatggaggcgtccccagagcagcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgctgtcggacgcctgagcctcccagccctgcccggctgctctgctctcgttaccgaccactaggggtggcagggccgccccggccatgtttacagccccggccctcgacagtactgagccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccacgggctcaggcgagtttctagaaagagtctatataaagagagaactaacgccaaaaaaaaaa

SEQ ID NO: 18 - protein, 1723 aa, Homo sapiens
IRHEVFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRVARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSERSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEALPMTGNWPRGPLNPQRKNGLMEASPEQRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCCRTPEPPSPARLLCSRYRPLGVAGPPRPCLQPRPSTVLSPEPPALVCTAPVPAPPRPAGPNLFWRHS

SEQ ID NO: 19 - DNA, 5740 bp, Homo sapiens
acgcgtgtggaggatgccacagagagggaggaagagggggatgagggaggccagacccacctgtctcccacagcacctgccccatctgcccagctgtttgcaccgaagacgctggtactggtgtcgcgactcgaccacacgggggggttcaggaccagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggtgagcctgtctgtcccacccccgcatggcttcccctcggggactggtagttagggatgtgggttctcactctgcctgggtgggggcccagggtcctctccaagcttctcttcttcctttaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagaccgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtggtgttgggacacctgggcgagatgtgagggtgggctcacttgagccactgaaaccagccaggtcttccctcaggccggacagatggcgcctgaccaaagttcctggcacctggaaaacccacagcagggcacgagtgacctgagaggcccactcaggcagaagagacgcaagctgggccgtccaactggtttcaactgccagctttaccaatgcagcatttattttaaaattaaattaaatta

SEQ ID NO: 20 - protein, 1681 aa, Homo sapiens
MASPRGLVVRDVGSHSAWVGAQGPLQASLLPLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEGPPYDWELAQGPPEPPEEERSDGGAPQSRRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCLSDA

SEQ ID NO: 21 - DNA, 762 bp, Homo sapiens
gacacaccatgcagtgcttcaaattcattaaggtcatgatgttcctcttcaatcaactcatctttctctgtggtgcagccctgttggctgtgggaatatgggtaaccgtcgatgggacatctttcctgaaggtcttcggatcactatcatccagtgccatgcagtttgtcaacgtgggctacttcctcatcgccgctggtgctgtgctcttcatttttggtttcctgggctgctatggtgctccctctgagaaacaagtgtgtgctctggtgatgttcttttccatcctcctcatcatcttcatcgctgagattgcaggtgctgtggttgctttggtgtacaccacattggctgaacaattcctgacactcctggtggtgcctgctatcgaaaaagactatggttaccagactgatttcacccaagtatggaacactacaatggaagagttgcattgctgtggctttaacaactacacagattttaatgcctcacgtttcgtcaaagagaataaagtcttccccccaccctgttgtgccaaccctggcaaccatacagttgaaccatgcaccgaggagaaggccaaaagtatgaaagtacagggttgtttcaaagagattctgcatagaatcagaaacaatgcagtcactgtgggtggtgtggcagttggagttgcggccctagagctggctgccatggttgtatccatgtatctatactgcaatctgaaataagactactacttcctcctgacttgctgcc

SEQ ID NO: 22 - protein, 241 aa, Homo sapiens
MQCFKFIKVMMFLFNQLIFLCGAALLAVGIWVTVDGTSFLKVFGSLSSSAMQFVNVGYFLIAAGAVLFIFGFLGCYGAPSEKQVCALVMFFSILLIIFIAEIAGAVVALVYTTLAEQFLTLLVVPAIEKDYGYQTDFTQVWNTTMEELHCCGFNNYTDFNASRFVKENKVFPPPCCANPGNHTVEPCTEEKAKSMKVQGCFKEILHRIRNNAVTVGGVAVGVAALELAAMVVSMYLYCNLK

SEQ ID NO: 23 - DNA, 469 bp, Homo sapiens
gccatctgccaaccatggtcaccactcagcagctgctaggaagatggcgcccagcagagaggaaatacctcaaagaaacagggatgagaatggccctgcaaaaaattggtgcaatgactaaaccagatggtgccatctctgatggcaaaagcttcactataaaaaccaagagcactctgaaaacaacacggttttcttctaaacttggagagaagtatgaaagaactacaggtgatggcagaaaaaactcactatttgtctgcaactttacaaagcgtgcattggttcaacactgggaatgggatgaggaaagaaaaacgagaagaagaaaagtgggagacaaaaaagcagggatggaatgcattatgaacaatgtcacctgtactcagatctgtgaaaataaaaaaagcagaataaaaatttccttactgctttggagagcaattagctgagagaaggaacaatttca

SEQ ID NO: 24 - protein, 145 aa, Homo sapiens
MVTTQQLLGRWRPAERKYLKETGMRMALQKIGAMTKPDGAISDGKSFTIKTKSTLKTTRFSSKLGEKYERTTGDGRKNSLFVCNFTKRALVQHWEWDEERKTRRRKVGDKKAGMECIMNNVTCTQICENKKSRIKISLLLWRAIS

SEQ ID NO: 25 - DNA, 816 bp, Homo sapiens
atggggggcctgacagcctcggacgtacacccgaccctgggggtccagctcttctcagctggaatagcggcgtgcttggcggacgtgatcaccttcccgctggacacggccaaagtccggctccaggtccaaggtgaatgcccgacgtccagtgttattaggtataaaggtgtcctgggaacaatcaccgctgtggtaaaaacagaagggcggatgaaactctacagcgggctgcctgcggggcttcagcggcaaatcagctccgcctctctcaggatcggcctctacgacacggtccaggagttcctcaccgcagggaaagaaacagcacctagtttaggaagcaagattttagctggtctaacgactggaggagtggcagtattcattgggcaacccacagaggtcgtgaaagtcagacttcaagcacagagccatctccacggaatcaaacctcgctacacggggacttataatgcgtacagaataatagcaacaaccgaaggcttgacgggtctttggaaagggactactcccaatctgatgagaagtgtcatcatcaattgtacagagctagtaacatatgatctaatgaaggaggcctttgtgaaaaacaacatattagcaggacagtacaaaagtgtgcccaactgtgcaatgaaagtgttcactaacgaaggaccaacggctttcttcaaggggttggtaccttccttcttgcgacttggatcctggaacgtcattatgtttgtgtgctttgaacaactgaaacgagaactgtcaaagtcaaggcagactatggactgtgccacataa

SEQ ID NO: 26 - protein, 271 aa, Homo sapiens
MGGLTASDVHPTLGVQLFSAGIAACLADVITFPLDTAKVRLQVQGECPTSSVIRYKGVLGTITAVVKTEGRMKLYSGLPAGLQRQISSASLRIGLYDTVQEFLTAGKETAPSLGSKILAGLTTGGVAVFIGQPTEVVKVRLQAQSHLHGIKPRYTGTYNAYRIIATTEGLTGLWKGTTPNLMRSVIINCTELVTYDLMKEAFVKNNILAGQYKSVPNCAMKVFTNEGPTAFFKGLVPSFLRLGSWNVIMFVCFEQLKRELSKSRQTMDCAT

SEQ ID NO: 27 - DNA, 1859 bp, Homo sapiens
gtaactcctcttcatccactggggaggaaggtgaggcaggcgggcccaattcattcgcctccggtacttgcaagcctcgctcagtcttaagcaagaggggatggattcgcccgcagcactgagaatccaggggcaggcgggatggcgttcaggcgctgttgctagaaatctctgtctttactctgttttggtcattacggagggaagacagcccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccgcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatcccgagggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgct

SEQ ID NO: 28 - protein, 553 aa, Homo sapiens
MDSPAALRIQGQAGWRSGAVARNLCLYSVLVITEGRQPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAASVVSCKPLVLGPSLFVLAARLWGGSQLWARPSPGLRLAPTQTLAPRRLLRPNDAELLWLEGQPCFVVADASKAGSTTLLCRDGPGFYPHQSLHAWHRDTDAEALELDGRPHLLLASASQRPVLFHWTGGRFERRTDIPRAEDVYATRHFQAGGDVFLCLTRYIGDSMVMRWDGSMFRLLQQLPSRGAHVFQPLLIARDQLAILGSDFAFSQVLRLEPDKGLLEPLQELGPPALVAPRAFAHITMAGRRFLFAACFKGPTQIYQHHEIDLSA

SEQ ID NO: 29 - DNA, 1482 bp, Homo sapiens
tcccgagactttggaagttctcagctattactttattacataggatttctgtgtcttttctcatctcttttccttttggaaattggaagacccccaaagggaaagtgtcccctgcgctgctcctgctctaaagacagcgccctgtgtgagggctccccggacctgcccgtcagcttctctccgaccctgctgtcactgactgcccacatccccagctcactcgtcaggacgggagtcacccagctgaaggccggcagcttcctgagaattccgtctctgcacctgctgctcttcacctccaactccttctccgtgattgaggacgatgcatttgcgggcctgtcccacctgcagtacctgttcatcgaggacaatgagattggctccatctctaagaatgccctcagaggacttcgctcgcttacacacctgagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcacagcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgtgcagcgcttccggcccgaggaagagctgcccgagcctgcacgcctggcaccgggacacggacgctgaggccctggagctggacggccggccccacctgctgctggcctcggcttcccagcggcccgtgctcttccactggaccggtggccgcttcgagagacgcacggacatccccgaggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccaattggccatcctaggcagcgacttcgccttcagccaggtcctccgccttgagcctgacaaggggctcctggagccactgcaggagctggggcctctggccctggtggccccccgtgcctttgcccacatcactatggccggcagacgcttcctctttgctgcttgctttaagggccccacacagatctaccagcatcacgagatcgacctcagtgcctga

SEQ ID NO: 30 - protein, 493 aa, Homo sapiens
SRDFGSSQLLLYYIGFLCLFSSLFLLEIGRPPKGKCPLRCSCSKDSALCEGSPDLPVSFSPTLLSLTAHIPSSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCTAASVVSCKPLVLGPSLFVLAARLWGGSQLWARPSPGLRLAPTQTLAPRRLLRPNDAELLWLEGQPCFVVADASKAGSTTCSASGPRKSCPSLHAWHRDTDAEALELDGRPHLLLASASQRPVLFHWTGGRFERRTDIPEAEDVYATRHFQAGGDVFLCLTRYIGDSMVMRWDGSMFRLLQQLPSRGAHVFQPLLIARDQLAILGSDFAFSQVLRLEPDKGLLEPLQELGPLALVAPRAFAHITMAGRRFLFAACFKGPTQIYQHHEIDLSA

SEQ ID NO: 31 - DNA, 430 bp, Homo sapiens
ggggaattcgcccttatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagtttgtacagaatcctggcataagctgctgtgagagcctagaactggaaaatacagtgtgccagttcactacaggcaaacaattccccaggtgccaataccatagtgttacctcattagagaagatattgacagtgctgacaggtcattctctgatgagctggttagtttgtggctctaagttgtaaatcccacagagctttaggac

SEQ ID NO: 32 - protein, 129 aa, Homo sapiens
MSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 33 - DNA, 1860 bp, Homo sapiens
atggacaggcacttgctgttgcctggtctgctcctgtcccttcctctgaccgcaggctggaccatctccaatagtttagtgactgaaggctcccggctgtctatggtctcccgcttcttcctgatttgcctcttggactccagcctgcctttcctcaccacatgcctctcagtgatcaacttggtgcgggccttggaaactgtgctgcagaacgtggagggtctctgtcaatctggttccacttctgctctgcctcaggatgccttctcccgctttcctgggctcaaggctgaagctggccagtcctggagccttccaggtcctcaagctggggactctgaatctggaccacacaaagatgaaggcagatgcactggtgggacgggggctgcagagattggatgccctgtgacactcactgacatggctgagctgcctgccaggatggttgcccattttgagcttcaggagctgaatttggggattaatcggacaaggcacatagccctggaaggcctggcttcctgtcacagcctgaagagctcgggtcttcggagcaatggcctgattgagttaccacgaggtttcctggctgccatgcccaggcttcagagactgaacctggccaacaaccaactgaggagcgccatgttgtgtatgaatgagacagggtttgtgtcaggattgtgggccctggatctgtccaagaataggctgtgtaccctgtccccagtcatcttctcctgtttgccccacctgcgggagctgctacttcaagggaaccaactggtttgcttgaaagaccaggtattccagggcctacagaggctacagaccttgaacttgggcaataatccactggtaaccctgggtgagggctggctggctcctctgcctacactgaccacccaaaacctggtaggtactcacatggtgctgagcccaacctggggcttccggggcccagaaagtctgcacagcttgagaatacagtttccctttggccctgcgggagtagcattttccctgctcacaagactgactagcttggagctccacgcagtttcaggcatgaagcattggaggttgtctcctaatgtctttccagtcttgcagatcctgactttaaagggctggggactgcagctagagacccagaatatctccaagatcttccctgcccttcatcaactctccctgcttggcactcccgaagctcaagtccttgaaggatggggaaacaggcatagccctaggccctactgcatcacgggactgcccagtctacaggagctgaagctgcaggcactgcagtctcaagcatgcccctgcccagtgcggcttgaggagctggtggggttggagacactgtctgctgctgcttttgggggcctcggcagtctccaggtcttagtactagacagggagaaagacttcatgctggatgacagcctccaggagcacagtcctcggatgccccagtacatctatattctgacctcatccttggcctgccagtgtgccaatgcctgcctctgccctgctgcttctgctggtctccttgcccttcctaaaggaagccaggaattcctggatcctctaactcaaggccttgctcagggtttggttccagagtctgaggagtcagaagggcaagaccagggctggatggtgcaggagctgctgcctgctctagaggactgccctccagctggccgggggctgccactctgcctccatgagtgggattttgagccaggcaaggatgtggctgacaatgcagcagacagcatgattggcctggttgctccgctgaagagactattgcatgtggcccaaggaagaggaaagaaagaatga

SEQ ID NO: 34 - protein, 619 aa, Homo sapiens [sequence omitted]

SEQ ID NO: 35 - DNA, 4660 bp, Homo sapiens
aattctgaactctattcagaggccttggggtggggcttgtttgtacatagtggccacataaagcctggtaaactcagctggtctccagggcgaggctgagggcagagagttggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactgtgccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacaggtaaggtaagattccgtgttgtctccgtggatgaaaattttcgccctcgaaatgaactggtaagccttgtttcccttcagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggatgttataggtacacatatggagagcctgtccctggtctggtgacacttagtgtatgcagaagatattcactatgccgttccgactgccacaacacacattcacagcttaacagcaatggctgcatcacccaacaagtacacaccaaaatgctccagattacaaatacgggctttgaaatgaagcttagagtggaagccaggatcagagaagaggggacaggtgtggaagtcactgcaaacaggatcagtgaaatcacaaacattgtatccaaactcaaattcgtgaaagtggattcacactttagacaaggaatccccttttttgcacaggtaagactggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggtaagttacaaagagagtaacaattgttctgataactggtggcttgatgaatttcatacgcaaacatctcatactgcaaagcattttttttccccaagcaagagttatattcacctcaaacctattattggtactttgacctgtggacaaacccaggagattcaagcacactacattctgaataaacagattctcagggatgaaaaagaattaaccttctactatttggtaaaagcaagaggaaaaatctcccaatcaggaatccatgtgttatccattgaacaaggaaacagtaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtgtataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgagctcatcaggtgtggctgaggtaggagtaacagtccctgacaccatcaccgagtggaaggcaggggccttctgcctgtccgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggtagttgtgcagctggaggtctcttccgctttcctggctgttccaacagagaagaatgaagaatctcactgtgtctgtagaaatgggcggaaaaccgtgtcctgggttgtgactccgaagtcactgggtaatgtgaacttctcagtgagtgcagaggcaatgcagtccttagaactctgtggaaatgaggttgttgaggtccctgagattaaaagaaaagacacagtcatcaaaaccctgttggtggagcctgaaggaatagcaaaggaggaaactttcaacacgctgccctgtgcatcaggtgctaatgtgtctgagcagttgtccttgaagctcccatcaaatgtggtcaaagaatctgccagagcttctttctcagttctgggtggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccaaacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgctaacccatcaaaccctgcatttttccttctttgtggaacaagacatccaaataaagaatttaaaaccagctacagtaaaagcctatgattattatgagacatcagatgaattcacctttgaagaatacaatgccccttgcagtgctggtaaagtataaatgattcaatctaatgccacttgaaagaaaataaataagcatctcagttaaacagtaaagtctaatcccaacttcaaaat

SEQ ID NO: 36 - protein, 1479 aa, Homo sapiens
MRKDRLLHLCLVLLLILLSASDSNSTEPQYMVLVPSLLHTEAPKKGCVLLSHLNETVTVSASLESGRENRSLFTDLVAEKDLFHCVSFTVPRISASSEVAFLSIQIKGPTQDFRKRNTVLVLNTQSLVFVQTDKPMYKPGQTGKVRFRVVSVDENFRPRNELVSLVSLQNPRRNRIAQWQSLKLEAGINQLSFPLSSEPIQGSYRVVVQTESGGRIQHPFTVEEFVLPKFEVKVQVPKIISIMDEKVNITVCGCYRYTYGEPVPGLVTLSVCRRYSLCRSDCHNTHSQLNSNGCITQQVHTKMLQITNTGFEMKLRVEARIREEGTGVEVTANRISEITNIVSKLKFVKVDSHFRQGIPFFAQVRLVDGKGVPIPNKLFFISVNDANYYSNATTNEQGLAQFSINTTSISVNKLFVRVSYKESNNCSDNWWLDEFHTQTSHTAKHFFSPSKSYIHLKPIIGTLTCGQTQEIQAHYILNKQILRDEKELTFYYLVKARGKISQSGIHVLSIEQGNSKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVSSSGVAEVGVTVPDTITEWKAGAFCLSEDAGLGISSTASLRAFQPFFVELTMPYSVIRGEVFTLKATVLNYLPKCIRVVVQLEVSSAFLAVPTEKNEESHCVCRNGRKTVSWVVTPKSLGNVNFSVSAEAMQSLELCGNEVVEVPEIKRKDTVIKTLLVEPEGIAKEETFNTLPCASGANVSEQLSLKLPSNVVKESARASFSVLGGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKDNLVHWERPQRPKAPVGHLYQTQAPSAEVEMTSYVLLAYLTAQPAPTSGDLTSATNIVKWIMKQQNAQGGFSSTQDTVVALHALSRYGAATFTRTEKTAQVTVQDSQTFSTNFQVDNNNLLLLQQISLPELPGEYVITVTGERCVYLQTSMKYNILPEKEDSPFALKVQTVPQTCDGHKAHTSFQISLTISYTGNRPASNMVIVDVKMVSGFIPLKPTVKMLERSSSVSRTEVSNNHVLIYVEQVLTHQTLHFSFFVEQDIQIKNLKPATVKAYDYYETSDEFTFEEYNAPCSAGKV

SEQ ID NO: 37 - DNA, 2895 bp, Homo sapiens
ctccaggtccgcctgtccctggaatgttctatgcaggccaggggttatggtagaaatagcgtcttgttggccgggctcctctgctggaccccttacccagccttagcaggcactgattctggcagcgaggtgctccctgactccttcccgtcagcgccagcagagccgctgccctacttcctgcaggagccacaggacgcctacattgtgaagaacaagcctgtggagctccgctgccgcgccttccccgccacacagatctacttcaagtgcaacggcgagtgggtcagccagaacgaccacgtcacacaggaaggcctggatgaggccaccggtctgcgggtgcgcgaggtgcagatcgaggtgtcgcggcagcaggtggaggagctctttgggctggaggattactggtgccagtgcgtggcctggagctccgcgggcaccaccaagagtcgccgagcctacgtccgcatcgcctgtctgcgcaagaacttcgatcaggagcctctgggcaaggaggtgcccctggaccatgaggttctcctgcagtgccgcccgccggagggggtgcctgtggccgaggtggaatggctcaagaatgaggatgtcatcgaccccacccaggacaccaacttcctgctcaccatcgaccacaacctcatcatccgccaggcccgcctgtcggacactgccaactatacctgcgtggccaagaacatcgtggccaaacgccggagcaccactgccaccgtcatcgtctacgtgaatggcggctggtccagctgggcagagtggtcaccctgctccaaccgctgtggccgaggctggcagaagcgcacccggacctgcaccaaccccgctccactcaacggaggggccttctgcgagggccaggcattccagaagaccgcctgcaccaccatctgcccagtcgatggggcgtggacggagtggagcaagtggtcagcctgcagcactgagtgtgcccactggcgtagccgcgagtgcatggcgcccccaccccagaacggaggccgtgactgcagcgggacgctgctcgactctaagaactgcacagatgggctgtgcatgcaaagtgagtcacagtgtggtcctcctgtccccgcagtgctggaggcctcaggggatgcggcgctgtatgcggggctcgtggtggccatcttcgtggtcgtggcaatcctcatggcggtgggggtggtggtgtaccgccgcaactgccgtgacttcgacacagacatcactgactcatctgctgccctgactggtggtttccaccccgtcaactttaagacggcaaggcccagtaacccgcagctcctacacccctctgtgcctcctgacctgacagccagcgccggcatctaccgcggacccgtgtatgccctgcaggactccaccgacaaaatccccatgaccaactctcctctgctggaccccttacccagccttaaggtcaaggtctacagctccagcaccacgggctctgggccaggcctggcagatggggctgacctgctgggggtcttgccgcctggcacataccctagcgatttcgcccgggacacccacttcctgcacctgcgcagcgccagcctcggttcccagcagctcttgggcctgccccgagacccagggagcagcgtcagcggcacctttggctgcctgggtgggaggctcagcatccccggcacaggtgtcagcttgctggtgcccaatggagccattccccagggcaagttctacgagatgtatctactcatcaacaaggcagaaagtaccctgccgctttcagaagggacccagacagtattgagcccctcggtgacctgtggacccacaggcctcctgctgtgccgccccgtcatcctcaccatgccccactgtgccgaagtcagtgcccgtgactggatctttcagctcaagacccaggcccaccagggccactgggaggaggtggtgaccctggatgaggagaccctgaacacaccctgctactgccagctggagcccagggcctgtcacatcctgctggaccagctgggcacctacgtgttcacgggcgagtcctattcccgctcagcagtcaagcggctccagctggccgtcttcgcccccgccctctgcacctccctggagtacagcctccgggtctactgcctggaggacacgcctgtagcactgaaggaggtgctggagctggagcggactctgggcggatacttggtggaggagccgaaaccgctaatgttcaaggacagttaccacaacctgcgcctctccctccatgacctcccccatgcccattggaggagcaagctgctggccaaataccaggagatccccttctatcacatttggagtggcagccagaaggccctccactgcactttcaccctggagaggcacagcttggcctccacagagctcacctgcaagatctgcgtgcggcaagtggaaggggagggccagatattccagctgcataccactctggcagagacacctgctggctccctggacactctctgctctgcccctggcagcactgtcaccacccagctgggaccttatgccttcaagatcccactgtccatccgccagaagatatgcaacagcctagatgcccccaactcacggggcaatgactggcggatgttagcacagaagctctctatggaccggtacctgaattactttgccaccaaagcgagccccacgggtgtgatcctggacctctgggaagctctgcagcaggacgatggggacctcaacagcctggcgagtgccttggaggagatgggcaagagtgagatgctggtggctgtggccaccgacggggactgctgagcctcctgggacagcgggctggcaggg

SEQ ID NO: 38 - protein, 945 aa, Homo sapiens
MQARGYGRNSVLLAGLLCWTPYPALAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIACLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQSESQCGPPVPAVLEASGDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYFATKASPTGVILDLWEALQQDDGDLNSLASALEEMGKSEMLVAVATDGDC

SEQ ID NO: 39 - DNA, 192 bp, Homo sapiens
tttttcttttcaggctttcttctagtcaagatgagtgataaaccagacttgtcggaagtggagaagtttgacaggtcaaaactgaagaaaactaatactgaagaaaaaaatactcttccctcaaaggaaagtaagtcatgtggggttctactggaaacaaacaatagaggaagttaataggttcagtaaata

SEQ ID NO: 40 - protein, 48 aa, Homo sapiens [sequence omitted]

SEQ ID NO: 41 - DNA, 594 bp, Homo sapiens
ctgggttttggcggccgatcaggcgcagccggtgtacctgcgtgaccaggtcgccacgccgaaagcaccgccggcatgacaactggtcggatgcttggcgtcaggattccttcggcatttgccaaggacgcagcccgccgctacattgccagcactgtcccttgttcagccgagcccaccgagcagtcctagatgcggatcgacggttacctaccttcctactcgccagatcgtggcccccgttcggggactgcggtcacgccctatcgagaggcgcagcgggaggtcgaggctcagcgtgaacagccggctgccccagccagcagccaggggctggagcaggcgccgcagattcgccgcgtgcaggccagcagcagtaacaccgatagcctgccgacccgctcgcaggacctcggttatcaacaacctacgttgagcaaccgtgccgctcaggcgttggccagctacagcaccaccgccgcttacgccagcgagtacgatgcgcaggaagtgctcggcctcgatctctacgcgtaaccccgtttcacggcgtgggtcagcccctcagctggaccgtcgcatagatcgatgagc

SEQ ID NO: 42 - protein, 114 aa, Homo sapiens
MRIDGYLPSYSPDRGPRSGTAVTPYREAQREVEAQREQPAAPASSQGLEQAPQIRRVQASSSNTDSLPTRSQDLGYQQPTLSNRAAQALASYSTTAAYASEYDAQEVLGLDLYA

SEQ ID NO: 43 - DNA, 1102 bp, Homo sapiens
gggcccttgtcctgggccatggcccagaagggggtcctggggcctgggcagctgggggctgtggccaattctgactcatactcactttacgggttggtgccgtccggacccgctaggggccccccgtactgcgggcgccctgagccctcggcccgcatcgtggggggctcaaacgcgcagccgggcacctggccttggcaagtgagcctgcaccatggaggtggccacatctgcgggggctccctcatcgccccctcctgggtcctctccgctgctcactgtttcatgacgaatgggacgttggagcccgcggccgagtggtcggtactgctgggcgtgcactcccaggacgggcccctggacggcgcgcacacccgcgcagtggccgccatcgtggtgccggccaactacagccaagtggagctgggcgccgacctggccctgctgcgcctggcctcacccgccagcctgggccccgccgtgtggcctgtctgcctgccccgcgcctcacaccgcttcgtgcacggcaccgcctgctgggccaccggctggggagacgtccaggaggcagatcctctgcctctcccctgggtgctacaggaagtggagctaaggctgctgggcgaggccacctgtcaatgtctctacagccagcccggtcccttcaacctcactctccagatattgccagggatgctgtgtgctggctacccagagggccgcagggacacctgccagggtgactctggggggcccctggtctgtgaggaaggcggccgctggttccaggcaggaatcaccagctttgggtttggctgtggacggagaaaccgccctggagttttcactgctgtggctacctatgaggcatggatacgggagcaggtgatgggttcagagcctgggcctgcctttcccacccagccccagaagacccagtcagattgtttacatcaaacggcattcctggattctgccagaatccttttgaggcccttgtcccatatatcagtaggagtctcaactgggaccaaaagccttgtcctcccctggctctctccacactctctcctgggcctctgggggttctgatggggcctcc

SEQ ID NO: 44 - protein, 344 aa, Homo sapiens
MAQKGVLGPGQLGAVANSDSYSLYGLVPSGPARGPPYCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDCLHQTAFLDSARILLRPLSHISVGVSTGTKSLVLP

SEQ ID NO: 45 - DNA, 1102 bp, Homo sapiens; identical to SEQ ID NO: 43

SEQ ID NO: 46 - protein, 357 aa, Homo sapiens
MAQKGVLGPGQLGAVANSDSYSLYGLVPSGPARGPPYCGRPEPSARIVGGSNAQPGTWPWQVSLHHGGGHICGGSLIAPSWVLSAAHCFMTNGTLEPAAEWSVLLGVHSQDGPLDGAHTRAVAAIVVPANYSQVELGADLALLRLASPASLGPAVWPVCLPRASHRFVHGTACWATGWGDVQEADPLPLPWVLQEVELRLLGEATCQCLYSQPGPFNLTLQILPGMLCAGYPEGRRDTCQGDSGGPLVCEEGGRWFQAGITSFGFGCGRRNRPGVFTAVATYEAWIREQVMGSEPGPAFPTQPQKTQSDCLHQTAFLDSARILLRPLSHISVGVSTGTKSLVLPWLSPHSLLGLWGF

SEQ ID NO: 47 - protein, 3635 aa, Mus musculus
DLYCKLVGGPVAGGDPNQTIQGQYCDICTAANSNKAHPVSNAIDGTERWWQSPPLSRGLEYNEVNVTLDLGQVFHVAYVLIKFANSPRPDLWVLERSTDFGHTYQPWQFFASSKRDCLERFGPRTLERITQDDDVICTTEYSRIVPLENGEIVVSLVNGRPGALNFSYSPLLRDFTKATNIRLRFLRTNTLLGHLMGKALRDPTVTRRYYYSIKDISIGGRCVCHGHADVCDAKDPLDPFRLQCACQHNTCGGSCDRCCPGFNQQPWKPATTDSANECQSCNCHGHAYDCYYDPEVDRRNASQNQDNVYQGGGVCLDCQHHTTGINCERCLPGFFRAPDQPLDSPHVCRPCDCESDFTDGTCEDLTGRCYCRPNFTGELCAACAEGYTDFPHCYPLPSFPHNDTREQVLPAGQIVNCDCNAAGTQGNACRKDPRLGRCVCKPNFRGAHCELCAPGFHGPSCHPCQCSSPGVANSLCDPESGQCMCRTGFEGDRCDHCALGYFHFPLCQLCGCSPAGTLPEGCDEAGRCQCRPGFDGPHCDRCLPGYHGYPDCHACACDPRGALDQQCGVGGLCHCRPGNTGATCQECSPGFYGFPSCIPCHCSADGSLHTTCDPTTGQCRCRPRVTGLHCDMCVPGAYNFPYCEAGSCHPAGLAPANPALPETQAPCMCRAHVEGPSCDRCKPGYWGLSASNPEGCTRCSCDPRGTLGGVTECQGNGQCFCKAHVCGKTCAACKDGFFGLDYADYFGCRSCRCDVGGALGQGCEPKTGACRCRPNTQGPTCSEPAKDHYLPDLHHMRLELEEAATPEGHAVRFGFNPLEFENFSWRGYAHMMAIQPRIVARLNVTSPDLFRLVFRYVNRGSTSVNGQISVREEGKLSSCTNCTEQSQPVAFPPSTEPAFVTVPQRGFGEPFVLNPGIWALLVEAEGVLLDYVVLLPSTYYEAALLQHRVTEACTYRPSALHSTENCLVYAHLPLDGFPSAAGTEALCRHDNSLPRPCPTEQLSPSHPPLATCFGSDVDIQLEMAVPQPGQYVLVVEYVGEDSHQEMGVAVHTPQRAPQQGVLNLHPCPYSSLCRSPARDTQHHLAIFHLDSEASIRLTAEQAHFFLHSVTLVPVEEFSTEFVEPRVFCVSSHGTFNPSSAACLASRFPKPPQPIILKDCQVLPLPPDLPLTQSQELSPGAPPEGPQPRPPTAVDPNAEPTLLRHPQGTVVFTTQVPTLGRYAFLLHGYQPVHPSFPVEVLINGGRIWQGHANASFCPHGYGCRTLVLCEGQTMLDVTDNELTVTVRVPEGRWLWLDYVLIVPEDAYSSSYLQEEPLDKSYDFISHCATQGYHISPSSSSPFCRNAATSLSLFYNNGALPCGCHEVGAVSPTCEPFGGQCPCRGHVIGRDCSRCATGYWGFPNCRPCDCGARLCDELTGQCICPPRTVPPDCLVCQPQSFGCHPLVGCEECNCSGPGVQELTDPTCDMDSGQCRCRPNVAGRRCDTCAPGFYGYPSCRPCDCHEAGTMASVCDPLTGQCHCKENVQGSRCDQCRVGTFSLDAANPKGCTRCFCFGATERCGNSNLARHEFVDMEGWVLLSSDRQVVPHEHRPEIELLHADLRSVADTFSELYWQAPPSYLGDRVSSYGGTLHYELHSETQRGDIFIPYESRPDVVLQGNQMSIAFLELAYPPPGQVHRGQLQLVEGNFRHLETHNPVSREELMMVLAGLEQLQIRALFSQTSSSVSLRRVVLEVASEAGRGPPASNVELCMCPANYRGDSCQECAPGYYRDTKGLFLGRCVPCQCHGHSDRCLPGSGICVGCQHNTEGDQCERCRPGFVSSDPSNPASPCVSCPCPLAVPSNNFADGCVLRNGRTQCLCRPGYAGASCERCAPGFFGNPLVLGSSCQPCDCSGNGDPNMIFSDCDPLTGACRGCLRHTTGPHCERCAPGFYGNALLPGNCTRCDCSPCGTETCDPQSGRCLCKAGVTGQRCDRCLEGYFGFEQCQGCRPCACGPAAKGSECHPQSGQCHCQPGTTGPQCLECAPGYWGLPEKGCRRCQCPRGHCDPHTGHCTCPPGLSGERCDTCSQQHQVPVPGKPGGHGIHCEVCDHCVVLLLDDLERAGALLPAIREQLQGINASSAAWARLHRLNASIADLQSKLRRPPGPRYQAAQQLQTLEQQSISLQQDTERLGSQATGVQGQAGQLLDTTESTLGRAQKLLESVRAVGRALNELASRMGQGSPGDALVPSGEQLRWALAEVERLLWDMRTRDLGAQGAVAEAELAEAQRLMARVQEQLTSFWEENQSLATHIRDQLAQYESGLMDLREALNQAVNTTREAEELNSRNQERVKEALQWKQELSQDNATLKATLQAASLILGHVSELLQGIDQAKEDLEHLAASLDGAWTPLLKRMQAFSPASSKVDLVEAAEAHAQKLNQLAINLSGIILGINQDRFIQRAVEASNAYSSILQAVQAAEDAAGQALRQASRTWEMVVQRGLAAGARQLLANSSALEETILGHQGRLGLAQGRLQAAGIQLHNVWARKNQLAAQIQEAQAMLAMDTSETSEKIAHAKAVAAEALSTATHVQSQLQGMQKNVERWQSQLGGLQGQDLSQVERDASSSVSTLEKTLPQLLAKLSRLENRGVHNASLALSANIGRVRKLIAQARSAASKVKVSMKFNGRSGVRLRPPRDLADLAAYTALKFHIQSPVPAPEPGKNTGDHFVLYMGSRQATGDYMGVSLRNQKVHWVYRLGKAGPTTLSIDENIGEQFAAVSIDRTLQFGHMSVTVEKQMVHEIKGDTVAPGSEGLLNLHPDDFVFYVGGYPSNFTPPEPLRFPGYLGCIEMETLNEEVVSLYNFEQTFMLDTAVDKPCARSKATGDPWLTDGSYLDGSGFARISFEKQFSNTKRFDQELRLVSYNGIIFFLKQESQFLCLAVQEGTLVLFYDFGSGLKKADPLQPPQALTAASKAIQVFLLAGNRKRVLVRVERATVFSVDQDNMLEMADAYYLGGVPPEQLPLSLRQLFPSGGSVRGCIKGIKALGKYVDLKRLNTTGISFGCTADLLVGRTMTFHGHGFLPLALPDVAPITEVVYSGFGFRGTQDNNLLYYRTSPDGPYQVSLREGHVTLRFMNQEVETQRVFADGAPHYVAFYSNVTGVWLYVDDQLQLVKSHERTTPMLQLQPEEPSRLLLGGLPVSGTFHNFSGCISNVFVQRLRGPQRVFDLHQNMGSVNVSVGCTPAQLIETSRATAQKVSRRSRQPSQDLACTTPWLPGTIQDAYQFGGPLPSYLQFVGISPSHRNRLHLSMLVRPHAASQGLLLSTAPMSGRSPSLVLFLNHGHFVAQTEGPGPRLQVQSRQHSRAGQWHRVSVRWGMQQIQLVVDGSQTWSQKALHHRVPRAERPQPYTLSVGGLPASSYSSKLPVSVGFSGCLKKLQLDKQPLRTPTQMVGVTPCVSGPLEDGLFFPGSEGVVTLELPKAKMPYVSLELEMRPLAAAGLIFHLGQALATPYMQLKVLTEQVLLQANDGAGEFSTWVTYPKLCDGRWHRVAVIMGRDTLRLEVDTQSNHTTGRLPESLAGSPALLHLGSLPKSSTARPELPAYRGCLRKLLINGAPVNVTASVQIQGAVGMRGCPSGTLALSKQGKALTQRHAKPSVSPLLWH

SEQ ID NO: 48 - protein, 3712 aa, Drosophila melanogaster
MGHGVASIGALLVILAISYCQAELTPPYFNLATGRKIYATATCGPDTDGPELYCKLVGANTEHDHIDYSVIQGQVCDYCDPTVPERNHPPENAIDGTEAWWQSPPLSRGMKFNEVNLTINFEQEFHVAYLFIRMGNSPRPGLWTLEKSTDYGKTWTPWQHFSDTPADCETYFGKDTYKPITRDDDVICTTEYSKIVPLENGEIPVMLLNERPSSTNYFNSTVLQEWTRATNVRIRLLRTKNLLGHLMSVARQDPTVTRRYFYSIKDISIGGRCMCNGHADTCDVKDPKSPVRILACRCQHHTCGIQCNECCPGFEQKKWRQNTNARPFNCEPCNCHGHSNECKYDEEVNRKGLSLDIHGHYDGGGVCQNCQHNTVGINCNKCKPKYYRPKGKHWNETDVCSPCQCDYFFSTGHCEEETGNCECRAAFQPPSCDSCAYGYYGYPNCRECECNLNGTNGYHCEAESGQQCPCKINFAGAYCKQCAEGYYGFPECKACECNKIGSITNDCNVTTGECKCLTNFGGDNCERCKHGYFNYPTCSYCDCDNQGTESEICNKQSGQCICREGFGGPRCDQCLPGFYNYPDCKPCNCSSTGSSAITCDNTGKCNCLNNFAGKQCTLCTAGYYSYPDCLPCHCDSHGSQGVSCNSDGQCLCQPNFDGRQCDSCKEGFYNFPSCEDCNCDPAGVIDKFAGCGSVPVGELCKCKERVTGRICNECKPLYWNLNISNTEGCEICDCWTDGTISALDTCTSKSGQCPCKPHTQGRRCQECRDGTFDLDSASLFGCKDCSCDVGGSWQSVCDKISGQCKCHPRITGLACTQPLTTHFFPTLHQFQYEYEDGSLPSGTQVRYDYDEAAFPGFSSKGYVVFNAIQNDVRNEVNVFKSSLYRIVLRYVNPNAENVTATISVTSDNPLEVDQHVKVLLQPTSEPQFVTVAGPLGVKPSAIVLDPGRYVFTTKANKNVMLDYFVLLPAAYYEAGILTRHISNPCELGNMELCRHYKYASVEVFSPAATPFVIGENSKPTNPVETYTDPEHLQIVSHVGDIPVLSGSQNELHYIVDVPRSGRYIFVIDYISDRNFPDSYYINLKLKDNPDSETSVLLYPCLYSTICRTSVNEDGMEKSFYINKEDLQPVIISADIEDGSRFPIISVTAIPVDQWSIDYINPSPVCVIHDQQCATPKFRSVPDSKKIEFETDHEDRIATNKPPYASLDERVKLVHLDSQNEATIVIESKVDATKPNLFVILVKYYQPSHPKYQVYYTLTAGKNQYDGKFDIQHCPSSSGCRGVIRPAGEGSFEIDDEFKFTITTDRSQSVWLDYLVVVPLKQYNDDLLVEETFDQTKEFIQNCGHDHFHITHNASDFCKKSVFSLTADYNSGALPCNCDYAGSTSFECHPFGGQCQCKPNVIERTCGRCRSRYYGFPDCKPCKCPNSAMCEPTTGECMCPPNVIGDLCEKCAPNTYGFHQVIGCEECACNPMGIANGNSQCDLFNGTCECRQNIEGRACDVCSNGYFNFPHCEQCSCHKPGTELEVCDKIDGACFCKKNVVGRDCDQCVDGTYNLQESNPDGCTTCFCFGKTSRCDSAYLRVYNVSLLKHVSITTPEFHEESIKFDMWPVPADEILLNETTLKADFTLREVNDERPAYFGVLDYLLNQNNHISAYGGDLAYTLHFTSGFDGKYIVAPDVILFSEHNALVHTSYEQPSRNEPFTNRVNIVESNFQTISGKPVSRADFMMVLRDLKVIFIRANYWEQTLVTHLSDVYLTLADEDADGTGEYQFLAVERCSCPPGYSGHSCEDCAPGYYRDPSGPYGGYCIPCECNGHSETCDCATGICSKCQHGTEGDHCERCVSGYYGNATNGTPGDCMICACPLPFDSNNFATSCEISESGDQIHCECKPGYTGPRCESCANGFYGEPESIGQVCKPCECSGNINPEDQGSCDTRTGECLRCLNNTFGAACNLCAPGFYGDAIKLKNCQSCDCDDLGTQTCDPFVGVCTCHENVIGDRCDRCKPDHYGFESGVGCRACDCGAASNSTQCDPHTGHCACKSGVTGRQCDRCAVDHWKYEKDGCTPCNCNQGYSRGFGCNPNTGKCQCLPGVIGDRCDACPNRWVLIKDEGCQECNNCHHALLDVTDRMRYQIDSVLEDFNSVTLAFFTSQKLNYYDQLADELEPKVKLLDPNSVDLSPSKKANSELESDAKSYAKQVNQTLANAFDIRERSSTTLGNITVAYDEAVKSADQAKEAIASVEALSKNLEAAASTKIDAALEQAQHILGQINGTSIELTPNEQVLEKARKLYEEVNTLVLPIKAQNKSLNALKNDIGEFSDHLEDLFNWSEASQAKSADVERRNVANQKAFDNSKFDTVSEQKLQAEKNIKDAGNFLINGDLTLNQINQKLDNLRDALNELNSFNKNVDEELPVREDQHKEADALTDQAEQKAAELAIKAQDLAAQYTDMTASAEPAIKAATAYSGIVEAVEAAQKLSQDAISAAGNATDKTDGIEERAHLADTGSTDLLQRARQSLQKVQDDLEPRLNASAGKVQKISAVNNATEHQLKDINKLIDQLPAESQRDMWKNSNANASDALEILKNVLEILEPVSVQTPKELEKAHGINRDLDLTNKDVSQANKQLDDVEGSVSKLNELAEDIEEQQHRVGSQSRQLGQEIENLKAQVEAARQLANSIKVGVNFKPSTILELKTPEKTKLLATRTNLSTYFRTTEPSGFLLYLGNDNKTAQKNNDFVAVEIVNGYPILTIDLGNGPERITSDKYVADGRWYQAVVDRMGPNAKLTIREELPNGDVVEHSKSGYLEGSQNILHVDKNSRLFVGGYPGISDFNAPPDLTTNSFSGDIEDLKIGDESVGLWNFVYGDDNDQGARERDVLLEKKKPVTGLRFKGNGYVQLNATSNLKSRSSIQFSFKADKDTSNGLLFFYGRDKHYMSIEMIDGAIFFNISLGEGGGVQSGSQDRYNDNQWHKVQAERENRNGLLKVDDIVISRTNAPLEADLELPKLRRLYFGGHPRRLNTSISLQPNFDGCIDNVVINQGVVDLTEYVTGGGVEEGCSAKFSTVVSYAPHEYGFLRMNNVSSDNNLHVVLHFKTTQPNGVLFYAANHDQSSTIGLSLQDGLLKLNSMGSQLVIDDRILNDGEDHVVTVQHTQGELRLTVDDVDNKRLGSPQPLILEGGDIFFAGLPDNYRTPRNALASLAYFVGCISDVTVNEEIINFANSAEKKNGNINGCPPHVLAYEPSLVPSYYPSGDNEVESPWSNADTLPPLKPDIESTLPPTTPTTTTTTTTTTTSTTTTSTTTTTTTPSPIVIDEEKEIEAKTPQKILTTRPPAKLNLPSDERCKLPEQPNFDVDFTEAGYRFYGLREQRLQINSLPVKVRRHHDIGISFRTERPNGLLIYAGSKQRDDFIAVYLLDGRVTYEIRVGAQLQAKITTEAELNDGTWHTVEVVRTQRKVSLLIDKLEQPGSVDLNAERSAPVLAVELPIYLGGVNKFLESEVKNLTDFKTEVPYFNGCLKNIKFDAMDLETPPEEFGVVPCSEQVERGLFFNNQKAFVKIFDHFDVGTEMKISFDFRPRDPNGLLFSVHGKNSYAILELVDNTLYFTVKTDLKNIVSTNYKLPNNESFCDGKTRNVQAIKSKFVINIAVDFISSNPGVGNEGSVITRTNRPLFLGGHVAFQRAPGIKTKKSFKGCISKVEVNQRMINITPNMVVGDIWQGYCPLN

SEQ ID NO: 49 - protein, 1634 aa, Homo sapiens
MAAGAAARVLVDRPPRAPSATPRADSATADQGPWDPSAASVPLATGGSLSRAAGAASALGAAVTLTRAAATAPRGSAGSAATPAASSIRCLFQAGLWATASTVKVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRRLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 50 - protein, 953 aa, Homo sapiens
SGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRWLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 51 - protein, 3712 aa, Drosophila melanogaster
MGHGVASIGALLVILAISYCQAELTPPYFNLATGRKIYATATCGQDTDGPELYCKLVGANTEHDHIDYSVIQGQVCDYCDPTVPERNHPPENAIDGTEAWWQSPPLSRGMKFNEVNLTINFEQEFHVAYLFIRMGNSPRPGLWTLEKSTDYGKTWTPWQHFSDTPADCETYFGKDTYKPITRDDDVICTTEYSKIVPLENGEIPVMLLNERPSSTNYFNSTVLQEWTRATNVRIRLLRTKNLLGHLMSVARQDPTVTRRYFYSIKDISIGGRCMCNGHADTCDVKDPKSPVRILACRCQHHTCGIQCNECCPGFEQKKWRQNTNARPFNCEPCNCHGHSNECKYDEEVNRKGLSLDIHGHYDGGGVCQNCQHNTVGINCNKCKPKYYRPKGKHWNETDVCSPCQCDYFFSTGHCEEETGNCECRAAFQPPSCDSCAYGYYGYPNCRECECNLNGTNGYHCEAESGQQCPCKINFAGAYCKQCAEGYYGFPECKACECNKIGSITNDCNVTTGECKCLTNFGGDNCERCKHGYFNYPTCSYCDCDNQGTESEICNKQSGQCICREGFGGPRCDQCLPGFYNYPDCKPCNCSSTGSSAITCDNTGKCNCLNNFAGKQCTLCTAGYYSYPDCLPCHCDSHGSQGVSCNSDGQCLCQPNFDGRQCDSCKEGFYNFPSCEDCNCDPAGVIDKFAGCGSVPVGELCKCKERVTGRICNECKPLYWNLNISNTEGCEICDCWTDGTISALDTCTSKSGQCPCKPHTQGRRCQECRDGTFDLDSASLFGCKDCSCDVGGSWQSVCDKISGQCKCHPRITGLACTQPLTTHFFPTLHQFQYEYEDGSLPSGTQVRYDYDEAAFPGFSSKGYVVFNAIQNDVRNEVNVFKSSLYRIVLRYVNPNAENVTATISVTSDNPLEVDQHVKVLLQPTSEPQFVTVAGPLGVKPSAIVLDPGRYVFTTKANKNVMLDYFVLLPAAYYEAGILTRHISNPCELGNMELCRHYKYASVEVFSPAATPFVIGENSKPTNPVETYTDPEHLQIVSHVGDIPVLSGSQNELHYIVDVPRSGRYIFVIDYISDRNFPDSYYINLKLKDNPDSETSVLLYPCLYSTICRTSVNEDGMEKSFYINKEDLQPVIISADIEDGSRFPIISVTAIPVDQWSIDYINPSPVCVIHDQQCATPKFRSVPDSKKIEFETDHEDRIATNKPPYASLDERVKLVHLDSQNEATIVIESKVDATKPNLFVILVKYYQPSHPKYQVYYTLTAGKNQYDGKFDIQHCPSSSGCRGVIRPAGEGSFEIDDEFKFTITTDRSQSVWLDYLVVVPLKQYNDDLLVEETFDQTKEFIQNCGHDHFHITHNASDFCKKSVFSLTADYNSGALPCNCDYAGSTSFECHPFGGQCQCKPNVIERTCGACRSRYYGFPDCKPCKCPNSAMCEPTTGECMCPPNVIGDLCEKCAPNTYGFHQVIGCEECACNPMGIANGNSQCDLFNGTCECRQNIEGRACDVCSNGYFNFPHCEQCSCHKPGTELEVCDKIDGACFCKKNVVGRDCDQCVDGTYNLQESNPDGCTTCFCFGKTSRCDSAYLRVYNVSLLKHVSITTPEFHEESIKFDMWPVPADEILLNETTLKADFTLREVNDERPAYFGVLDYLLNQNNHISAYGGDLAYTLHFTSGFDGKYIVAPDVILFSEHNALVHTSYEQPSRNEPFTNRVNIVESNFQTISGKPVSRADFMMVLRDLKVIFIRANYWEQTLVTHLSDVYLTLADEDADGTGEYQFLAVERCSCPPGYSGHSCEDCAPGYYRDPSGPYGGYCIPCECNGHSETCDCATGICSKCQHGTEGDHCERCVSGYYGNATNGTPGDCMICACPLPFDSNNFATSCEISESGDQIHCECKPGYTGPRCESCANGFYGEPESIGQVCKPCECSGNINPEDQGSCDTRTGECLRCLNNTFGAACNLCAPGFYGDAIKLKNCQSCDCDDLGTQTCDPFVGVCTCHENVIGDRCDRCKPDHYGFESGVGCRACDCGAASNSTQCDPHTGHCACKSGVTGRQCDRCAVDHWKYEKDGCTPCNCNQGYSRGFGCNPNTGKCQCLPGVIGDRCDACPNRWVLIKDEGCQECNNCHHALLDVTDRMRYQIDSVLEDFNSVTLAFFTSQKLNYYDQLADELEPKVKLLDPNSVDLSPSKKANSELESDAKSYAKQVNQTLANAFDIRERSSTTLGNITVAYDEAVKSADQAKEAIASVEALSKNLEAAASTKIDAALEQAQHILGQINGTSIELTPNEQVLEKARKLYEEVNTLVLPIKAQNKSLNALKNDIGEFSDHLEDLFNWSEASQAKSADVERRNVANQKAFDNSKFDTVSEQKLQAEKNIKDAGNFLINGDLTLNQINQKLDNLRDALNELNSFNKNVDEELPVREDQHKEADALTDQAEQKAAELAIKAQDLAAQYTDMTASAEPAIKAATAYSGIVEAVEAAQKLSQDAISAAGNATDKTDGIEERAHLADTGSTDLLQRARQSLQKVQDDLEPRLNASAGKVQKISAVNNATEHQLKDINKLIDQLPAESQRDMWKNSNANASDALEILKNVLEILEPVSVQTPKELEKAHGINRDLDLTNKDVSQANKQLDDVEGSVSKLSELAEDIEEQQHRVGSQSRQLGQEIENLKAQVEAARQLANSIKVGVNFKPSTILELKTPEKTKLLATRTNLSTYFRTTEPSGFLLYLGNDNKTAQKNNDFVAVEIVNGYPILTIDLGNGPERITSDKYVADGRWYQAVVDRMGPNAKLTIREELPNGDVVEHSKSGYLEGSQNILHVDKNSRLFVGGYPGISDFNAPPDLTTNSFSGDIEDLKIGDESVGLWNFVYGDDNDQGARERDVLLEKKKPVTGLRFKGNGYVQLNATSNLKSRSSIQFSFKADKDTSNGLLFFYGRDKHYMSIEMIDGAIFFNISLGEGGGVQSGSQDRYNDNQWHKVQAERENRNGLLKVDDIVISRTNAPLEADLELPKLRRLYFGGHPRRLNTSISLQPNFDGCIDNVVINQGVVDLTEYVTGGGVEEGCSAKFSTVVSYAPHEYGFLRMNNVSSDNNLHVVLHFKTTQPNGVLFYAANHDQSSTIGLSLQDGLLKLNSMGSQLVIDDRILNDGEDHVVTVQHTQGELRLTVDDVDNKRLGSPQPLILEGGDIFFAGLPDNYRTPRNALASLAYFVGCISDVTVNEEIINFANSAEKKNGNINGCPPHVLAYEPSLVPSYYPSGDNEVESPWSNADTLPPLKPDIESTLPPTTPTTTTTTTTTTTSTTTTSTTTTTTTPSPIVIDEEKEIEAKTPQKILTTRPPAKLNLPSDERCKLPEQPNFDVDFTEAGYRFYGLREQRLQINSLPVKVRRHHDIGISFRTERPNGLLIYAGSKQRDDFIAVYLLDGRVTYEIRVGAQLQAKITTEAELNDGTWHTVEVVRTQRKVSLLIDKLEQPGSVDLNAERSAPVLAVELPIYLGGVNKFLESEVKNLTDFKTEVPYFNGCLKNIKFDAMDLETPPEEFGVVPCSEQVERGLFFNNQKAFVKIFDHFDVGTEMKISFDFRPRDPNGLLFSVHGKNSYAILELVDNTLYFTVKTDLKNIVSTNYKLPNNESFCDGKTRNVQAIKSKFVINIAVDFISSNPGVGNEGSVITRTNRPLFLGGHVAFQRAPGIKTKKSFKGCISKVEVNQRMINITPNMVVGDIWQGYCPLN

SEQ ID NO: 52 - protein, 239 aa, Artificial Sequence
  Description of Artificial Sequence: Laminin N-terminal domain Consensus Sequence
AGRPRRCYPEFVNLAFGRPVTASSTCGEQGPERYCKLVGRTEQGKKCDYCDARDPRRSHPAENLTDGNNPGNPTWWQSEPLSNGPQNVNLTLDLGKEFHLTYVILKFCSPRPSLAILERSDFGKTWQPYQYFSSDCRRTFGRPPRGPITKGNEQEVLCTSEYSDIVPLEGGEIAFSTLEGRPSATDFDNSPVLQEWVTATNIRVRLTRLNTLGDDLMDKRDPEVTRSYYYAISDIAVGG

SEQ ID NO: 53 - protein, 237 aa, Artificial Sequence
  Description of Artificial Sequence: Laminin N-Terminal Domain Consensus Sequence
CYPATGNLAIGRALSATSTCGLHSPEPYCILSHLQPRDKKCFLCDSNSPNPRNSHPISFLTDTFNPQSPTWWQSETMQNGVQYPNVTITLDLEAEFHFTYVIITFKTFRPAAMIYERSSDFGTWIPYQYYAYDCEATYPGIPRRPIRTGRAEDDVLCTSRYSDIEPLTEGEVIFSTLEGRPSADNFDPSPRLQEWLKATNIRITLTRLHTLGDNLLDSDPEVLEKYYYAISDIVVGG

SEQ ID NO: 54 - protein, 127 aa, Artificial Sequence
  Description of Artificial Sequence: Laminin B Domain Consensus Sequence
DNEPVYWVAPEQFLGDKVTSYGGKLRYTLSFDGREGGTTLSAPDVILEGNGLRLSHPAQGPPLPDEETTNEVRFREENWQYFGGRPVTREDLMMVLANLTAILIRATYSEQQLASRLSDVSLEVAVP

SEQ ID NO: 55 - protein, 135 aa, Artificial Sequence
  Description of Artificial Sequence: Laminin B domain Consensus Sequence
YWRLPERFLGDQVTSYGGKLKYSVAFDGVGTSNSEPDVILKGNGLRLSVPYMAQGNSYPSEVRVKYTVRLHETFWDFQSQPAVTREDFLSVLANLTAILIRATYSAGQAQSRLDDVSLEIARPGAAGPVPATWVE

SEQ ID NO: 56 - protein, 135 aa, Artificial Sequence
  Description of Artificial Sequence: Laminin G Domain Consensus Sequence
TRLSISFSFRTTSPNGLLLYAGSKGGGDFLALELRDGRLVLRYDLGSGPARLTSDPTPLNDGQWHRVSVERNGRRVTLSVDGGNRVSGESPGGSTILDLDGPLYLGGLPEDLKLPGLPVTPGFRGCIRNLKVNGK

SEQ ID NO: 57 - protein, 49 aa, Artificial Sequence
  Description of Artificial Sequence: Laminin EGF-like Consensus Sequence
CDCNPHGSLSDTCDPETGQCLCKPGVTGRRCDRCKPGYYGLPSDPGQGC

SEQ ID NO: 58 - protein, 47 aa, Artificial Sequence
  Description of Artificial Sequence: Laiminin EGF-like Consensus Sequence
CDCDPGGSASTCDPETGQCECKPNTTGRRCDRCAPGYYGLPESPPGC

SEQ ID NO: 59 - protein, 860 aa, Artificial Sequence
  Description of Artificial Sequence: Mysosin Tail Consensus Sequence
ELERQKRELENQLYRKESELSQLSSKLEDEQALVAQLQKKIKELEARIRELEEELEAERAARAKAEKARADLSRELEELSERLEEAGGATAAQIELNKKREAELAKLRKDLEEANLQHEEALATLRKKHQDAINELSEQIEQLQKQKAKAEKEKSQLQAEVDDLLAQLDSITKAKLNAEKKAKQLESQLSELQVKLDELQRQLNDLTSQKSRLQSENSDLTRQLEEAEAQVSNLSKLKSQLESQLEEAKRSLEEESRERANLQAQLRQLEHDLDSLREQLEEESEAKAELERQLSKANAEIQQWRSKFESEGALRAEELEELKKKLNQKISELEEAAEAANAKCDSLEKTKSRLQSELEDLQIELERANAAASELEKKQKNFDKILAEWKRKVDELQAELDTAQREARNLSTELFRLKNELEELKDQVEALRRENKNLQDEIHDLTDQLGEGGRNVHELEKARRRLEAEKDELQAALEEAEAALELEESKVLRAQVELSQIRSEIERRLAEKEEEFENTRKNHQRAIESLQATLEAETKGKAEASRLKKKLEGDINELEIALDHANKANAEAQKNVKKYQQQVKELQTQVEEEQRAREDAREQLAVAERRATALEAELEELRSALEQAERARKQAETELAEASERVNELTAQNSSLIAQKRKLEGELAALQSDLDEAVNELKAAEERAKKAQADAARLAEELRQEQEHSQHLERLRKQLESQVKELQVRLDEAEAAALKGGKKMIQKLEARVRELEAELDGEQRRHAETQKNLRKMERRVKELQFQVEEDKKNLERLQDLVDKLQAKIKTYKRQLEEAEEVAQINLSKYRKAQRELEDAEERADTAERSLNKLRAKSRRT

SEQ ID NO: 60 - protein, 134 aa, Artificial Sequence
  Description of Artificial Sequence: Laiminin G domain Consensus Sequence
FRTTEPSGLLLYGGTNTDRDFLALELRDGRLEVSYDLGSGPAVVRSGDRLNDGKWHRVELERNGRKGTLSVDGEESVDGESPSGPDVPHENLDLDTPLYVGGLPELSVKRLLAAISTSFKGCIRDVIVNGKPLD

SEQ ID NO: 61 - protein, 391 aa, Homo sapiens
MDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 62 - protein, 390 aa, Homo sapiens [sequence omitted]

SEQ ID NO: 63 - protein, 391 aa, Homo sapiens [sequence omitted]

SEQ ID NO: 64 - protein, 339 aa, Homo sapiens [sequence omitted]

SEQ ID NO: 65 - protein, 390 aa, Homo sapiens [sequence omitted]

SEQ ID NO: 66 - protein, 377 aa, Artificial Sequence
  Description of Artificial Sequence: Serpin Consensus Sequence
DSSRALKLASANADFAFSLYKELVEQNPDKNIFFSPVSISSALAMLSLGAKGNTATQILEVLGFNLTETSEAEIHQGFQHLLQELNRPDTGLQLTTGNALFVDKSLKLLDEFLEDSKRLYQSEVFSVDFSDPEEAKKQINDWVEKKTQGKIKDLLKDLDSDTVLVLVNYIYFKGKWKKPFDPELTEEEDFHVDKKTTVKVPMMNQLGTFYYFRDEELNCKVLELPYKGNATSMLFILPDEVGKLEQVEAALSPETLRKWLENMEPREVELYLPKFSIEGTYDLKDVLAKLGITDLFSNQADLSGISEDEDLKVSKAVHKAVLEVDEEGTEAAAATGAIIVPRSLPPELEFTADRPFLFLIYDDPTGSILFMGKVVNP

SEQ ID NO: 67 - protein, 360 aa, Artificial Sequence
  Description of Artificial Sequence: Serpin Consensus Sequence
FDLYKELAKESPDKNIFFSPVSISSALAMLSLGAKGSTATQILEVLGFNLTETSEADIHQGFQHLLHLLNRPDNKLQLKTANALFVDKSLKLLDSFLEDVKKLYGAEVQSVDFSDPAEEAKKQINDWVKKKTQGKIKDLLSDLDPDTRLVLVNAIYFKGKWKTPFDPENTREEDFYVDETTTVKVPMMSQTGRTFRYGRDEELNCQVLELPYKGNASMLIILPDEGGLETVEKALTPETLKKWTKSLTKRSVELYLPKFKLEISYDLKDVLEKLGITDLFSNKADLSGISEDKDLKVSKVVHKAFLEVNEEGTEAAAATGVIIVPRSLPPPEFKANRPFLFLIRDNPTGSILFMGKVVNP

SEQ ID NO: 68 - protein, 1697 aa, Homo sapiens
IRHEVFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRVARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVRQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHGKWGSVRTSGRSSGLGTDVGSRLAGRDALAPPQANGGPPDPGFLRPQRAALYILGDKAQLKGVRSDPLQQWELVPIEVFEARQVKASFKKLLKACVPGCPAAEPSPASFLRSLEDSEWLIQIHKLLQVSVLVVELLDSGSSVLVGLEDGWDITTQVVSLVQLLSDPFYRTLEGFRLLVEKEWLSFGHRFSHRGAHTLAGQSSGFTPVFLQFLDCVHQVHLQFPMEFEFSQFYLKFLGYHHVSRRFRTFLLDSDYERIELGLLYEEKGERRGQVPCRSVWEYVDRLSKRTPVFHNYMYAPEDAEVLRPYSNVSNLKVWDFYTEETLAEALPMTGNWPRGPLNPQRKNGLMEASPEQRRVVWPCYDSCPRAQPDAISRLLEELQRLETELGQPAERWKDTWDRVKAAQRLEGRPDGRGTPSSLLVSTAPHHRRSLGVYLQEGPVGSTLSLSLDSDQSSGSTTSGSRQAARRSTSTLYSQFQTAESENRSYEGTLYKKGAFMKPWKARWFVLDKTKHQLRYYDHRVDTECKGVIDLAEVEAVAPGTPTMGAPKTVDEKAFFDVKTTRRVYNFCAQDVPSAQQWVDRIQSCCRTPEPPSPARLLCSRYRPLGVAGPPRPCLQPRPSTVLSPEPPALVCTAPVPAPPRPAGPNLFWRHS

SEQ ID NO: 69 - protein, 552 aa, Homo sapiens
DLFFKYTWNNFLHFQVELCIAAILSHAAREERTEASGSESRVEPPHENGNRSLETPQPAASLPDNTMVTHLFQKCCLVQRILEAWEANDHTQAAGGMRRGNMGHLTRIANAVVQNLERGPVQTHISEVIRGLPADCRGRWESFVEETLTETNRRNTVDLAFSDYQIQQMTANFVDQFGFNDEEFADQDDNINAPFDRIAEINFNIDADEDSPSAALFEACCSDRIQPFDDDEDEDIWEDSDTRCAARVMARPRFGAPHASESCSKNGPERGGQDGKASLEAHRDAPGAGAPPAPGKKEAPPVEGDSEAGAMWTAVFDEPANSTPTAPGVVRDVGSSVWAAGTSAPEEKGWAKFTDFQPFCCSESGPRCSSPVDTECSHAEGSRSQGPEKAFSPASPCAWNVCVTRKAPLLASDSSSSGGSHSEDGDQKAASAMDAVSRGPGREAPPLPTVARTEEAVGRVGCADSRLLSPACPAPKEVTAAPAVAVPPEATVAITTALSKAGPAIPTPAVSSALAVAVPLGPIMAVTAAPAMVATLGTVTKDGQMPRQKELP

SEQ ID NO: 70 - protein, 1327 aa, Homo sapiens
MSAPSSSPRAAEPARAPRAAPRPSPWRGSRTTSCWWRSGRTRAGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLALLFPLRYSFTYVPILPAQLLEVLSTPTPFIIGVNAAFQAETQELLDVIVADLDGGTVTIPECVHIPPLPEPLQSQTHSVLSMVLDPELELADLAFPPPTTSTSSLKMQDKELRAVFLRLFAQLLQGYRWCLHVVRIHPEPVIRFHKAAFLGQRGLVEDDFLMKVLEGMAFAGFVSERGVPYRPTDLFDELVAHEVARMRADENHPQRVLRHVQELAEQLYKNENPYPAVAMHKVQRPGESSHLRRVPRPFPRLDEGTVQWIVDQAAAKMQGAPPAVKAERRTTVPSGPPMTAILERCSGLHVNSARRLEVVRNCISYVFEGKMLEAKKLLPAVLRALKGRAARRCLAQELHLHVQQNRAVLDHQQFDFVVRMMNCCLQDCTSLDEHGIAAALLPLVTAFCRKLSPGVTQFAYSCVQEHVVWSTPQFWEAMFYGDVQTHIRALYLEPTEDLAPAQEVGEAPSQEDERSALDVASEQRRLWPTLSREKQQELVQKEESTVFSQAIHYANRMSYLLLPLDSSKSRLLRERAGLGDLESASNSLVTNSMAGSVAESYDTESGFEDAETCDVAGAVVRFINRFVDKVCTESGVTSDHLKGLHVMVPDIVQMHIETLEAVQRESRRLPPIQKPKLLRPRLLPGEECVLDGLRVYLLPDGREEGAGGSAGGPALLPAEGAVFLTTYRVIFTGMPTDPLVGEQVVVRSFPVAALTKEKRISVQTPVDQLLQDGLQLRSCTFQLLKMAFDEEVGSDSAELFRKQLHKLRYPPDIRATFAFTLGSAHTPGRPPRVTKDKGPSLRTLSRNLVKNAKKTIGRQHVTRKKYNPPSWEHRGQPPPEDQEDEISVSEELEPSTLTPSSALKPSDRMTMSSLVERACCRDYQRLGLGTLSSSLSRAKSEPFRISPVNRMYAICRSYPGLLIVPQSVQDNALQRVSRCYRQNRFPVVCWRSGRSKAVLLRSGGLHGKGVVGLFKAQNAPSPGQSQADSSSLEQEKYLQAVVSSMPRYADASGRNTLSGFSSAHMGSHVPSPRARVTTLSNPMAASASRRTAPRG

SEQ ID NO: 71 - protein, 1123 aa, Homo sapiens
RFPQKDWDDTPFPQGIELFCQPGGWQLSRERKQPTFFVVVLTDIDSDRHYCSCLTFYEAEINLQGTKKEEIEGEAKVSGLIQPAEVFAPKSLVLVSRLYYPEIFRACLGLIYTVYVDSLNVSLESLIANLCACLVPAAGGSQKLFSLGAGDRQLIQTPLHDSLPITGTSVALLFQQLGIQNVLSLFCAVLTENKVLFHSASFQRLSDACRALESLMFPLKYSYPYIPILPAQLLEVLSSPTPFIIGVHSVFKTDVHELLDVIIADLDGGTIKIPECIHLSSLPEPLLHQTQSALSLILHPDLEVADHAFPPPRTALSHSKMLDKEVRAVFLRLFAQLFQGYRSCLQLIRIHAEPVIHFHKTAFLGQRGLVENDFLTKVLSGMAFAGFVSERGPPYRSCDLFDELVAFEVERIKVEENNPVKMIKHVRELAEQLFKNENPNPHMAFQKVPRPTEGSHLRVHILPFPEINEARVQELIQENVAKNQNAPPATRIEKKCVVPAGPPVVSIMDKVTTVFNSAQRLEVVRNCISFIFENKILETEKTLPAALRALKGKAARQCLTDELGLHVQQNRAILDHQQFDYIIRMMNCTLQDCSSLEEYNIAAALLPLTSAFYRKLAPGVSQFAYTCVQDHPIWTNQQFWETTFYNAVQEQVRSLYLSAKEDNHAPHLKQKDKLPDDHYQEKTAMDLAAEQLRLWPTLSKSTQQELVQHEESTVFSQAIHFANLMVNLLVPLDTSKNKLLRTSAPGDWESGSNSIVTNSIAGSVAESYDTESGFEDSENTDIANSVVRFITRFIDKVCTESGVTQDHIKSLHCMIPGIVAMHIETLEAVHRESRRLPPIQKPKILRPALLPGEEIVCEGLRVLLDPDGREEATGGLLGGPQLLPAEGALFLTTYRILFRGTPHDQLVGEQTVVRSFPIASITKEKKITMQNQLQQNMQEGLQITSASFQLIKVAFDEEVSPEVVEIFKKQLMKFRYPQSIFSTFAFAAGQTTPQIILPKQKEKNTSFRTFSKTIVKGAKRAGKMTIGRQYLLKKKTGTIVEERVNRPGWNEDDDVSVSDESELPTSTTLKASEKSTMEQLVEKACFRDYQRLGLGTISGSSSRSRPEYFRITASNRMYSLCRR

SEQ ID NO: 72 - protein, 1728 aa, Drosophila melanogaster
MTENKILFLSKCYWHLTDSCRALVALMYPFRYTHVYIPILPAPLTEVLSTPTPFIMGIHSSLQTEITDLLDVIVVDLDGGLVTIPESLTPPVPILPSPLWEQTQDLLSMILFPNLAQADLAFPTLERPSAIAKTDAQIDKELRAIFMRLFAQLLQGYRSCLTIIRIHPKPVITFHKAGFLGARDLIESEFLFRVLDSMFFTTFVNERGPPWRSSDAWDELYSSMNELLKSEAQNRNLILTHIQELGRVLYENEGTLAHISYAQKVLRPPEGAFQRIHQPAFPRISSEKVELIIQEGIRKNGVPQRFHVTRNQHRIIPMGPRLPEALDVRPNVQNSARRLEVLRICVSYIFENRITDARKLLPAVMRTLMHRDARLILCREFFGYVHGNKAVLDHQQFELVVRFMNKALQKSSGIDEYTVAAALLPMSTIFCRKLSTGVVQFAYTEIQDHAIWKNLQFWESTFFQDVQGQIKALYLLHRRQNEHQKEANCVLDEVPLEEPTALEITAEQLRKSPNIEEEKKAELAKSEESTLYSQAIHFANRMVSLLIPLDVNVDAASKPKPAFRLEENQSVSNSIMGSHSLSEHSDEGFEENNALEIGVTVGKTISRFIDCVCTEGGVTSEHIRNLHDMVPGVVHMHIESLEPVYLEAKRHPHVQKPKIQTPCLLPGEDLVTDHLRCFLMPDGREDETQCLIPAEGALFLTNYRVIFKGSPCDPLFCEQVIVRTFPIASLLKEKKISVLYLAHLDQTLTEGLQLRSSSFQLIKVAFDPEVTPEQIESFRKILSKARHPFDEFEYFAFQSYGTMLQGVAPLKTKEKYSTLKGFAKKTLLRGAKKAGFKQKQQTKRKLVSDYDYGSADAQETQSIDDELEDGDEFETQNNAMPRLLTTKDVERMRERSYVQDWKRLGFDAESQRGFRISNANTSYATCRSYPAIIVAPVQCSDAAIMHLGRCFKGQRIPLPTWRHANGALLIRGGQPNSKSVIGMLKNTTGSTTNAHHDVTHYPEQDKYFLALINTMPKLTPLALNQYSGMNLSMSSLMGHSSSDDRQPLTPELSRKHKNNLDISDGNKSSQGGKGGTMKGNPKNSLAHPFRKMRLYALGEKSQAKSNMNVDFCADFIPVDYPDIRQSRPAFKKLIRACMPSHNTNEADGQSFAKMVEQSDWLQQISSLMQLSGAVVDLIDLQESSVMLSLEDGSDVTAQLSSIAQLCLDPYYRSLDGFRVLVEKEWLAFGHRFAHRSNLKPSHANTNIAFAPTFLQFLDVVHQLQRQFPMAFEFNDFYLRFLAYHSVSCRFRTFLFDCELERSDSGIAAMEDKRGSLNAKHMFGAGGMATNGSDDECSVYPLDIRSQRAPAPLNRIGHSIFDYIERQHNKTPIFYNFLYSGDKSVTLRPQNNVAALDLWCYYTNEELAQGAPYDLEVTTVDDEIDLSETKGKRMVITAGYDNMEKCNPSAYVCLLSEVKQAETERGHLPQKWLQVWNSLEVPQLEPVARNTSLGNIFVQTHQHKRSTLEIIMKGRLAGYQDKYFHPHRFEKHPYTTPTNCNHCTKLLWGPVGYRCMDCGNSYHEKCTEHSMKNCTKYKAIDGAVGPPNVNMSQGDTASIASSAATTARTSSHHFYNQFSSNVAENRTHEGHLYKRGALLKGWKQRWFVLDSIKHQLRYYDTSEDTAPKGIIELAEVQSVTAAQPAQIGAKGVDEKGFFDLKTSKRIYNFYAINANLAQEWIEKLQACLQ

SEQ ID NO: 73 - protein, 146 aa, Artificial Sequence
  Description of Artificial Sequence: DENN Consensus Sequence
LLSSPFPAPGKTLRFIELLPTDGNDVLELARPDPSRLPLVDASFHILFQALGVDQCLRVLASLLLEHKILFHSRKLSTLSSCCEAVVALLYPFEWQCPYIPLLPASLADVLLAPTPYLIGVPSSFFDNKLLELPPSDVICVDLDTN

SEQ ID NO: 74 - protein, 104 aa, Artificial Sequence
  Description of Artificial Sequence: Pleckstrin homology domain Consensus Sequence
VIKEGWLLKKSSGGKKSWKKRYFVLFNGVLLYYKSKKKKSSSKPKGSIPLSGCTVREAPDSDSDKKKNCFEIVTPDRKTLLLQAESEEERKEWVEALRKAIAKL

SEQ ID NO: 75 - protein, 100 aa, Artificial Sequence
  Description of Artificial Sequence: Pleckstrin homology domain Consensus Sequence
IVKEGWLLKKSTVKKKRWKKRYFFLFNDVLIYYKDKKKSYEPKGSIPLSGCSVEDVPDSEFKRPNCFQLRSRDGKETFILQAESEEERQDWIKAIQSAIR

SEQ ID NO: 76 - protein, 240 aa, Mus musculus
MQCFKFIKVMMFLFNLLIFLCGAALLAVGIWVSVDGTSFLKVFGSLSSSAMQFVNVGYFLIAAGAVLFILGFLGCYGAHSENKCVLMMFFSILLIIFIAEIAGAVVALVYTTLAEQFLTLLVVPAIEKDYGYQTDFTQVWNTTMEELHCCGFNNYTDFNASRFVKENKVFPPPCCANPGNHTVEPCTEEKAKSMKVQGCFKEILHRIRANAVTVGGVAVGVAALELAAMVVSMYLYCNLK

SEQ ID NO: 77 - protein, 241 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTEQKAHDQKVEGCFNQLLYDIRTNAVTVGGVAAGIGGLELAAMIVSMYLYCNLQ

SEQ ID NO: 78 - protein, 241 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 79 - protein, 247 aa, Gallus gallus
MEGDCLSCMKYLMFLFNFFIFLGGACLLGVGIWVIVDPTGFREIVAANPLLFTGAYIMLAMGAMLFLLGFLGCCGAIRENKCLLLFFFMFILLIFLAELSAAILAFIFRENLTREFFTKELKKHYVRNNDTHVFSSTWNSVMITFACCGVNGPEDFEAVPPLSHLPLEETTPEACCQRNVQSREGMFVNRKACLEGDERFQNRQGCYTVILNSFETYVYLAGALAIGVLAIELFAMIFAMCLFRGIQ

SEQ ID NO: 80 - protein, 282 aa, Caenorhabditis elegans
MGSCVNALRIVTFLFNFAFWLSGVVVFGLGIWLLFDPAASDFFALHSTHPGAFRYVGWFLVGAGAIIILVGYFGCIGAWKMNQCALAFFCCILILAFFLELAAAVTLFHKQEHIKHYVESSMYDTIRNRYSSETAFKDAFDTVQEKFECCGVKTYTDWLSARWDAEPSTQLEVNEEDAGRIEHGIGAFGGNKGTGYGRVPSSCCNEHGKLSYPNNCGRSFSQAPLNTYAQFINTRGCADAVYESVSSSLSLIVGVCVVLCIVQLLGIVLSMTLCCCKGNSKK

SEQ ID NO: 81 - protein, 222 aa, Artificial Sequence
  Description of Artificial Sequence: Tetraspanin Family Consensus Sequence
KYLLFLLNLLFWLCGILLLAVGIWLLVDLSSFSELLGSLSSLVAAYVLIAVGAILFLVGFLGCCGAIRESRCLLGLYFVFLLLIFILEVAAGILAFVFRDKLESSLNESLKNAIKNYYDTDPDERNAWDKLQEQFKCCGVNGYTDWFDSQWFSNGVPFSCCNPSVSCNSAQDEEDTIYQEGCLEKLLEWLEENLLIVGGVALGIALIQLLGMILSCCLCCSI

SEQ ID NO: 82 - protein, 135 aa, Bos taurus
MATVQQLVGRWRLVESKGFDEYMKEVGVGMALRKVGAMAKPDCIITSDGKNLSIKTESTLKTTQFSCKLGEKFEETTADGRKTQTVCNFTDGALVQHQEWDGKESTITRKLEDGKLVVVCVMNNVTCTRVYEKVE

SEQ ID NO: 83 - protein, 135 aa, Bos taurus
MATVQQLVGRWRLVESKGFDEYMKEVGVGMALRKVGAMAKPDCIITSDGKNPSIKTESTLKTTQFSCKLGEKFEETTADGRKTQTVCNFTDGALVQHQEWDGKESTITRKLEDGKLVVVCVMNNVTCTRVYEKVE

SEQ ID NO: 84 - protein, 135 aa, Homo sapiens
MATVQQLEGRWRLVDSKGFDEYMKELGVGIALRKMGAMAKPDCIITCDGKNLTIKTESTLKTTQFSCTLGEKFEETTADGRKTQTVCNFTDGALVQHQEWDGKESTITRKLKDGKLVVECVMNNVTCTRIYEKVE

SEQ ID NO: 85 - protein, 135 aa, Homo sapiens [sequence omitted]

SEQ ID NO: 86 - protein, 135 aa, Rattus norvegicus
MASLKDLEGKWRLVESHGFEDYMKELGVGLALRKMGAMAKPDCIITLDGNNLTVKTESTVKTTVFSCTLGEKFDETTADGRKTETVCTFTDGALVQHQKWEGKESTITRKLNDGKMVVECVMNNAICTRVYEKVQ

SEQ ID NO: 87 - protein, 307 aa, Homo sapiens
MGGLTASDVHPTLGVQLFSAGIAACLADVITFPLDTAKVRLQVQGECPTSSVIRYKGVLGTITAVVKTEGRMKLYSGLPAGLQRQISSASLRIGLYDTVQEFLTAGKETAPSLGSKILAGLTTGGVAVFIGQPTEVVKVRLQAQSHLHGIKPRYTGTYNAYRIIATTEGLTGLWKGTTPNLMRSVIINCTELVTYDLMKEAFVKNNILADDVPCHLVSALIAGFCATAMSSPVDVVKTRFINSPPGQYKSVPNCAMKVFTNEGPTAFFKGLVPSFLRLGSWNVIMFVCFEQLKRELSKSRQTMDCAT

SEQ ID NO: 88 - protein, 307 aa, Homo sapiens [sequence omitted]

SEQ ID NO: 89 - protein, 306 aa, Orycctolagus cuniculus
MVGTTTTDVPPTMGVKIFSAGVAACLADVITFPLDTAKVRQQIQGEFPITSGIRYKGVLGTITTLAKTEGPLKLYSGLPAGLQRQISFASLRIGLYDTVQEFFTSGEETPSLGSKISAGLTTGGVAVFIGQPTEVVKVRLQAQSHLHGLKPRYTGTYNAYRIIATTESLTSLWKGTTPNLLRNVIINCTELVTYDLMKGALVRNEILADDVPCHFVSALIAGFCTTLLSSPVDVVKTRFINSPPGQYASVPNCAMTMFTKEGPTAFFKGFVPSFLRLGSWNVIMFVCFEKLKGELMRSRQTVDCAT

SEQ ID NO: 90 - protein, 306 aa, Orycctolagus cuniculus
MVGTTTTDVPPTMGVKIFSAGVAACLADVITFPLDTAKVRQQIQGEFPITSGIRYKGVLGTITTLAKTEGPLKLYSGLPAGLQRQISFASLRIGLYDTVQEFFTSGEETPSLGSKISAGLTTGGVAVFIGQPTEVVKVRLQAQSHLHGLKPRYTGTYNAYRIIATTESLTSLWKGTTPNLLRNVIINCTELVTYDLMKGALVRNEILADDVPCHLLSALIAGFCTTLLSSPVDVVKTRFINSPPGQYASVPNCAMTMFTKEGPTAFFKGFVPSFLRLGSWDVIMFVCFEKLKGELMRSRQTVDCAT

SEQ ID NO: 91 - protein, 307 aa, Mesocricetus auratus
MVNPTTSEVHPTMGVKIFSAGVAACLADIITFPLDTAKVRLQIQGEGQISSTIRYKGVLGTITTLAKTEGLPKLYSGLPAGIQRQISFASLRIGLYDTVQEYFSSGKETPPTLGNRISAGLMTGGVAVFIGQPTEVVKVRLQAQSHLHGIKPRYTGTYNAYRIIATTESFSTLWKGTTPNLLRNVIINCVELVTYDLMKGALVNNQILADDVPCHLLSAFVAGFCTTFLASPADVVKTRFINSLPGQYPSVPSCAMTMLTKEGPTAFFKGFVPSFLRLASWNVIMFVCFEQLKKELSKSRQTVDCTT

SEQ ID NO: 92 - protein, 96 aa, Artificial Sequence
  Description of Artificial Sequence: Mitochondrial carrier protein Consensus Sequence
SPLSFLASLLAGGIAGAIAALVTYPLDVVKTRLQVQGSSSKYKGILDCFKKIVKEEGRAGLYKGLGPTLLRVAPYAAIYFGTYEQLKKLLGKKLGE

SEQ ID NO: 93 - protein, 96 aa, Artificial Sequence; identical to SEQ ID NO: 92
  Description of Artificial Sequence: Mitochondrial carrier protein Consensus Sequence

SEQ ID NO: 94 - protein, 557 aa, Mus musculus
MESESSRRMGNACIPLKRIAYFLCLFSVVLLTEGKKPAKPKCPAVCTCSKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNAFNCDCKLKWLVEWLGHTNATVEDIYCEGPPEYKKRKINSLSPKDFDCIITEFAKSQDLPYQSLSIDTFSYLNDEYVVIAQPFTGKCIFLEWDHVEKTFRNYDNITGTSTVVCKPIVIDTQLYVIVAQLFGGSHIYKRDGFANKFIKIQDIEVLKIRKPNDIETFKIEDNWYFVVADSSKAGFTTIYKWNGNGFYSHQSLHAWYRDTDVEYLEIARPPLALRTPHLILSSSSQRPVIYQWSKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 95 - protein, 557 aa, Homo sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 96 - protein, 461 aa, Homo sapiens
LFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 97 - protein, 542 aa, Homo sapiens
RRGGCGALGLLLLLLGAACLIPRSAQVRRLARCPATCSCTKESIICVGSSWVPRIVPGDISSLSLVNGTFSEIKDRMFSHLPSLQLLLLNSNSFTIIRDDAFAGLFHLEYLFIEGNKIETISRNAFRGLRDLTHLSLANNHIKALPRDVFSDLDSLIELDLRGNKFECDCKAKWLYLWLKMTNSTVSDVLCIGPPEYQEKKLNDVTSFDYECTTTDFVVHQTLPYQSVSVDTFNSKNDVYVAIAQPSMENCMVLEWDHIEMNFRSYDNITGQSIVGCKAILIDDQVFVVVAQLFGGSHIYKYDESWTKFVKFQDIEVSRISKPNDIELFQIDDETFFVIADSSKAGLSTVYKWNSKGFYSYQSLHEWFRDTDAEFVDIDGKSHLILSSRSQVPIILQWNKSSKKFVPHGDIPNMEDVLAVKSFRMQNTLYLSLTRFIGDSRVMRWNSKQFVEIQALPSRGAMTLQPFSFKDNHYLALGSDYTFSQIYQWDKEKQLFKKFKEIYVQAPRSFTAVSTDRRDFLFASSFKGKTKIFEHIIVDLSL

SEQ ID NO: 98 - protein, 1504 aa, Drosophila melanogaster
MAAPSRTTLMPPPFRLQLRLLILPILLLLRHDAVHAEPYSGGFGSSAVSSGGLGSVGIHIPGGGVGVITEARCPRVCSCTGLNVDCSHRGLTSVPRKISADVERLELQGNNLTVIYETDFQRLTKLRMLQLTDNQIHTIERNSFQDLVSLERLRLNNNRLKAIPENFVTSSASLLRLDISNNVITTVGRRVFKGAQSLRSLQLDNNQITCLDEHAFKGLVELEILTLNNNNLTSLPHNIFGGLGRLRALRLSDNPFACDCHLSWLSRFLRSATRLAPYTRCQSPSQLKGQNVADLHDQEFKCSGLTEHAPMECGAENSCPHPCRCADGIVDCREKSLTSVPVTLPDDTTDVRLEQNFITELPPKSFSSFRRLRRIDLSNNNISRIAHDALSGLKQLTTLVLYGNKIKDLPSGVFKGLGSLQLLLLNANEISCIRKDAFRDLHSLSLLSLYDNNIQSLANGTFDAMKSIKTVHLAKNPFICDCNLRWLADYLHKNPIETSGARCESPKRMHRRRIESLREEKFKCSWDELRMKLSGECRMDSDCPAMCHCEGTTVDCTGRGLKEIPRDIPLHTTELLLNDNELGRISSDGLFGRLPHLVKLELKRNQLTGIEPNAFEGASHIQELQLGENKIKEISNKMFLGLHQLKTLNLYDNQISCVMPGSFEHLNSLTSLNLASNPFNCNCHLAWFAEWLRKKSLNGGAARCGAPSKVRDVQIKDLPHSEFKCSSENSEGCLGDGYCPPSCTCTGTVVRCSRNQLKEIPRGIPAETSELYLESNEIEQIHYERIRHLRSLTRLDLSNNQITILSNYTFANLTKLSTLIISYNKLQCLQRHALSGLNNLRVLSLHGNRISMLPEGSFEDLKSLTHIALGSNPLYCDCGLKWFSDWIKLDYVEPGIARCAEPEQMKDKLILSTPSSSFVCRGRVRNDILAKCNACFEQPCQNQAQCVALPQREYQCLCQPGYHGKHCEFMIDACYGNPCRNNATCTVLEEGRFSCQCAPGYTGARCETNIDDCLGEIKCQNNATCIDGVESYKCECQPGFSGEFCDTKIQFCSPEFNPCANGAKCMDHFTHYSCDCQAGFHGTNCTDNIDDCQNHMCQNGGTCVDGINDYQCRCPDDYTGKYCEGHNMISMMYPQTSPCQNHECKHGVCFQPNAQGSDYLCRCHPGYTGKWCEYLTSISFVHNNSFVELEPLRTRPEANVTIVFSSAEQNGILMYDGQDAHLAVELFNGRIRVSYDVGNHPVSTMYSFEMVADGKYHAVELLAIKKNFTLRVDRGLARSIINEGSNDYLKLTTPMFLGGLPVDPAQQAYKNWQIRNLTSFKGCMKEVWINHKLVDFGNAQRQQKITPGCALLEGEQQEEEDDEQDFMDETPHIKEEPVDPCLENKCRRGSRCVPNSNARDGYQCKCKHGQRGRYCDQGEGSTEPPTVTAASTCRKEQVREYYTENDCRSRQPLKYAKCVGGCGNQCCAAKIVRRRKVRMVCSNNRKYIKNLDIVRKCGCTKKCY

SEQ ID NO: 99 - protein, 51 aa, Artificial Sequence
  Description of Artificial Sequence: Leucine Rich Repeat C-terminal Domain Consensus Sequence
NPFICDCELRWLLRWLQANRHLQDPVDLRCASPESLRGPLLLLLPSSFKCP

SEQ ID NO: 100 - protein, 51 aa, Artificial Sequence
  Description of Artificial Sequence: Leucine Rich Repeat C-terminal domain Consensus Sequence
NPFICDCELRWLLRWLREPRRLEDPEDLRCASPESLRGPLLELLPSDFSCP

SEQ ID NO: 101 - protein, 24 aa, Artificial Sequence
  Description of Artificial Sequence: Leucine-richrepeats Consensus Sequence
LPNLRELDLSNNQLSSLPPGAFQG

SEQ ID NO: 102 - protein, 199 aa, Homo sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 103 - protein, 124 aa, Balaenoptera acutorostrata
RESPAMKFQRQHMDSGNSPGNNPNYCNQMMMRRKMTQGRCKPVNTFVHESLEDVKAVCSQKNVLCKNGRTNCYESNSTMHITDCRQTGSSKYPNCAYKTSQKEKHIIVACEGNPYVPVHFDNSV

SEQ ID NO: 104 - protein, 503 aa, Cricetulus griseus
MLHVLWTFWILVAMTDLSRKGCSAQASLSCDAAGVCDGRSRSFTSIPSGLTAAMKSLDLSNNKITSIGHGDLRGCVNLRALILQSSGINTIEEDAFSSLSKLEYLDLSDNHLSNLSSSWFRPLSSLKYLNLLGNPYRILGETPLFLNLTHLQTLRVGNVATFSGIRRTDFAGLTSLDELEIKALSLQNYEPGSLQSIQSIHHLTFHLSQSDFLLGVFEDTLSSVGYLELRDANLDSFYFSELSTDEMNSPMKKLAFQNADLTDESFNELLKLLRYTPELLEVEFDDCTLNGVGDFQPSESDVVRELGKVETLIIRRLHIPRFYSFYDLSTVYTLLEKVKRITVENSKVFLVPCLFSQHLKSLEFLDLSENLMVEEYLKNAACEGSWPSLQTLILRQNRLKSIERTGKILLTLKNLTALDISRNSFQSMPDSCQWPGKMRFLNLSSTGIQAVKMCIPQTLEVLDVSNNNLISFSLFLPLLRELYISRNKLHTLPMPPCSLCYWS

SEQ ID NO: 105 - protein, 567 aa, Mus musculus
MLRSALLSAVLALLRAQPFPCPKTCKCVVRDAAQCSGGSVAHIAELGLPTNLTHILLFRMDQGILRNHSFSGMTVLQRLMLSDSHISAIDPGTFNDLVKLKTLRLTRNKISRLPRAILDKMVLLEQLFLDHNALRDLDQNLFQQLRNLQELGLNQNQLSFLPANLFSSLRELKLLDLSRNNLTHLPKGLLGAQVKLEKLLLYSNQLTSVDSGLLSNLGALTELRLERNHLRSVAPGAFDRLGNLSSLTLSGNLLESLPPALFLHVSSVSRLTLFENPLEELPDVLFGEMAGLRELWLNGTHLSTLPAAAFRNLSGLQTLGLTRNPRLSALPRGVFQGLRELRVLALHTNALAELRDDALRGLGHLRQVSLRHNRLRALPRTLFRNLSSLESVQLEHNQLETLPGDVFAALPQLTQVLLGHNPWLCDCGLWPFLQWLRHHPDILGRDEPPQCRGPEPRASLSFWELLQGDPWCPDPRSLPLDPPTENALEAPVPSWLPNSWQSQTWAQLVARGESPNNRLYWGLYILLLVAQAIIAAFIVFAMIKIGQLFRTLIREKLLLEAMGKSCN

SEQ ID NO: 106 - protein, 567 aa, Mus musculus
MLRSALLSAVLPLLRAQPFPCPKTCKCVVRDAAQCSGGSVAHIAELGLPTNLTHILLFRMDQGILRNHSFSGMTVLQRQMLSDSHISAIDPGTFNDLVKLKTLRLTRNKISRLPRAILDKMVLLEQLFLDHNALRDLDQNLFQQLRNLQELGLNQNQLSFLPANLFSSLRELKLLDLSRNNLTHLPKGLLGAQVKLEKLLLYSNQLTSVDSGLLSNLGALTELRLERNHLRSVAPGAFDRLGNLSSLTLSGNLLESLPPALFLHVSSVSRLTLFENPLEELPDVLFGEMAGLRELWLNGTHLSTLPAAAFRNLSGLQTLGLTRNPRLSALPRGVFQGLRELRVLGLHTNALAELRDDALRGLGHLRQVSLRHNRLRALPRTLFRNLSSLESVQLEHNQLETLPGDVFAALPQLTQVLLGHNPWLCDCGLWRFLQWLRHHPDILGRDEPPQCRGPEPRASLSFWELLQGDPWCPDPRSLPLDPPTENALEAPVPSWLPNSWQSQTWAQLVARGESPNNRLYWGLYILLLVAQAIIAAFIVFAMIKIGQLFRTLIREKLLLEAMGKSCN

SEQ ID NO: 107 - protein, 661 aa, Mus musculus
MAPDISCFFLVALFLASCRATTSSDQKCIEKEVNKTYNCENLGLNEIPGTLPNSTECLEFSFNVLPTIQNTTFSRLINLTFLDLTRCQIYWIHEDTFQSQHRLDTLVLTANPLIFMAETALSGPKALKHLFFIQTGISSIDFIPLHNQKTLESLYLGSNHISSIKLPKGFPTEKLKVLDFQNNAIHYLSKEDMSSLQQATNLSLNLNGNDIAGIEPGAFDSAVFQSLNFGGTQNLLVIFKGLKNSTIQSLWLGTFEDMDDEDISPAVFEGLCEMSVESINLQKHYFFNISSNTFHCFSGLQELDLTATHLSELPSGLVGLSTLKKLVLSANKFENLCQISASNFPSLTHLSIKGNTKRLELGTGCLENLENLRELDLSHDDIETSDCCNLQLRNLSHLQSLNLSYNEPLSLKTEAFKECPQLELLDLAFTRLKVKDAQSPFQNLHLLKVLNLSHSLLDISSEQLFDGLPALQHLNLQGNHFPKGNIQKTNSLQTLGRLEILVLSFCDLSSIDQHAFTSLKMMNHVDLSHNRLTSSSIEALSHLKGIYLNLASNHISIILPSLLPILSQQRTINLRQNPLDCTCSNIYFLEWYKENMQKLEDTEDTLCENPPLLRGVRLSDVTLSCSMAAVGIFFLIVFLLVFAILLIFAVKYFLRWKYQHI

SEQ ID NO: 108 - protein, 312 aa, Homo sapiens
VTLSPKDCQVFRSDHGSSISCQPPAEIPGYLPADTVHLAVEFFNLTHLPANLLQGASKLQELHLSSNGLESLSPEFLRPVPQLRVLDLTRNALTGLPPGLFQASATLDTLVLKENQLEVLEVSWLHGLKALGHLDLSGNRLRKLPPGLLANFTLLRTLDLGENQLETLPPDLLRGPLQLERLHLEGNKLQVLGKDLLLPQPDLRYLFLNGNKLARVAAGAFQGLRQLDMLDLSNNSLASVPEGLWASLGQPNWDMRDGFDISGNPWICDQNLSDLYRWLQAQKDKMFSQNDTRCAGPEAVKGQTLLAVAKSQ

SEQ ID NO: 109 - protein, 141 aa, Artificial Sequence
  Description of Artificial Sequence: TIR Domain Consensus Sequence
AFISFSGKDDRDTFVSHLLKELEEKPGIKLFIDDRDELPGESILENLFEAIEKSRRAIVILSSNYASSSWCLDELVEAVKLALEQGNKKVILPIFYKVDPSDVRKQSGKFGKAFLKTLKWFGDKTSQRIRFWKKALYAMPV

SEQ ID NO: 110 - protein, 1242 aa, Homo sapiens
MDEKVNITVCGEYTYGKPVPGLATVSLCRKLSRVLNCDKQEVCEEFSQQLNSNGCITQQVHTKMLQITNTGFEMKLRVEARIREEGTDLEVTANRISEITNIVSKLKFVKVDSHFRQGIPFFAQVLLVDGKGVPIPNKLFFISVNDANYYSNATTNEQGLAQFSINTTSISVNKLFVRVFTVHPNLCFHYSWVAEDHQGAQHTANRVFSLSGSYIHLEPVAGTLPCGHTETITAHYTLNRQAMGELSELSFHYLIMAKGVIVRSGTHTLPVESGDMKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVNSSGVAEVGVTVPDTITEWKAGAFCLSEDAGLGISSTASLRAFQPFFVELTMPYSVIRGEVFTLKATVLNYLPKCIRVSVQLKASPAFLASQNTKGEESYCICGNERQTLSWTVTPKTLGNVNFSVSAEAMQSLELCGNEVVEVPEIKRKDTVIKTLLVEAEGIEQEKTFSSMTCASGANVSEQLSLKLPSNVVKESARASFSVLGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKEDNLVHWERPQRPKAPVGHLYQTQAPSAEVEMTSYVLLAYLTAQPAPTSGDLTSATNIVKWIMKQQNAQGGFSSTQDTVVALHALSRYGAATFTRTEKTAQVTVQDSQTFSTNFQVDNNNLLLLQQISLPELPGEYVITVTGERCVYLQTSMKYNILPEKEDSPFALKVQTVPQTCDGHKAHTSFQISLTISYTGNRPASNMVIVDVKMVSGFIPLKPTVKMLERSSSVSRTEVSNNHVLIYVEQVTNQTLSFSFMVLQDIPVGDLKPAIVKVYDYYETDESVVAEYIAPCSTDTEHGNV

SEQ ID NO: 111 - protein, 1495 aa, Mus musculus
MRRNQLPTPAFLLLFLLLPRDATTATAKPQYVVLVPSEVYQESLKRPCVSLNHVNETVMLSLTLEYAMQQTKLLTDQAVDKDSFYCSPFTISGSPLPYTFITVEIKGPTQRFIKKKSIQIIKAESPVFVQTDKPIYKPGQIVKFRVVSVDISFRPLNETFPVVYIETPKRNRIFQWQNIHLAGGLHQLSFPLSVEPALGIYKVVVQKDSGKKIEHSFEVKEYVLPKFEVIIKMQKTMAFLEEELPITACGVYTYGKPVPGLVTLRVCRKYSRYRSTCHNQNSMSICAEFSQQADDKGCFSQVVKTKVFQLSQKGHDMKIEVEAKIKEEGTGIELTGIGSCEIANALSKLKFTKVNTNYRPGLPFSGQVLLVDEKGKPIPNKNITSVVSPLGYLSIFTTDEHGLANISIDTSNFTAPFLRVVVTYKQNHVCYDNWWLDEFHTQADHSATLVFSPSQSYIQLELVFGTLACGQTQEIRIHYLLNEDIMKNEKTLTFYYLIKARGSIGNLGSHVLSLEQGNMKGVFSLPIQVEPGMAPEAQLLIYAILPNEELVADAQNFEIEKCFANKVNLSFPSAQSLPASDTHLKVKAAPLSLCALTAVDQSVLLLKPEAKLSPQSIYNLLPGKTVQGAFFGVPVYKDHENCISGEDITHNGIVYTPKHSLGDNDAHSIFQSVGINIFTNSKIHKPRFCQEFQHYPAMGGVAPQALAVAASGPGSSFRAMGVPMMGLDYSDEINQVVEVRETVRKYFPETWIWDLVPLDVSGDGELAVKVPDTITEWKASAFCLSGTTGLGSSSTISLQAFQPFFLELTLPYSVVRGEAFTLKATVLNYMSHCIQIRVDLEISPDFLAVPVGGHENSHCICGNERKTVSWAVTPKSLGEVNFTRTAEALESQELCGNKLTEVPALVHKDTVVKSVIVEPEGIEKEQTYNTLLCPQDTELQDNSSLELPPNVVEGSARATHSVLGDILGSAMQNLQNLLQMPYGCGEQNMVLFVPNIYVLNYLNETQQLTEAIKSKAINYLISGYQRQLNYQHSDGSYSTFGNHGGGNTPGNTWLTAFVLKAFAQAQSHIFIEKTHITNAFNWLSMKQKENGCFQQSGYLLNNAMKGGVDDEVTLSAYITIALLEMPLPVTHSAVRNALFCLETAWASISQSQESHVYTKALLAYAFALAGNKAKRSELLESLNKDAVKEEDSLHWQRPGDVQKVKALSFYQPRAPSAEVEMTAYVLLAYLTSESSRPTRDLSSSDLSTASKIVKWISKQQNSDGGLLLTQDTVVALQALSKYGSATFTRSQKEVLVTSRSSGTFSKTFHVNSGNRLLLQEVRLPDLPGNYVTKGSGSGCVYLQTSLKYNILPVADGKAPFALQVNTLPLNFDKAEDHRTFQIRINVSYTGERPSSNMVIVDVKMVSGFIPMKPSVKRLQDQPNIQRTEVNTNHVLIYIEKLTNQTLGFSFAVEQDIPVKNLKPAPIKVYDYYETDEFTVEEYSAPFSDGSEQGNA

SEQ ID NO: 112 - protein, 1473 aa, Gallus gallus
MHCFLGREILSFFCLTVRKMWLKFILAILLLHAAAGKEPEPQYVLMVPAVLQSDSPSQVCLQFFNLNQTISVRVVLEYDTINTTIFEKNTTTSNGLQCLNFMIPPVTSVSLAFISFTAKGTTFDLKERRSVMIWNMESFVFVQTDKPIYKPGQSVMFRVVALDFNFKPVQEMYPLIAVQDPQNNRIFQWQNVTSEINIVQIEFPLTEEPILGNYKIIVTKKSGERTSHSFLVEEYVLPKFDVTVTAPGSLTVMDSELTVKICAVYTYGQPVEGKVQLSVCRDFDSYGRCKKSPVCQSFTKDLDTDGCLSHILSSKVFELNRIGYKRNLDVKAIVTEKEQVCNLTATQSISITQVMSSLQFENVDHHYRRGIPYFGQIKLVDKDNSPISNKVIQLFVNNKNTHNFTTDINGIAPFSIDTSKIFDPELSLKALYKTSDQCHSEGWIEPSYPDASLSVQRLYSWTSSFVRIEPLWKDMSCGQKRMITVYYILNTEGYEHINIVNFYYVGMAKGKIVLTGEIKVNIQADQNGTFMIPLVVNEKMAPALRLLVYMLHPAKELVADSVRFSIEKCFKNKVQLQFSEKQMLTTSNVSLVIEAAANSFCAVRAVDKSMLLLKSETELSAETIYNLHPIQDLQGYIFNGLNLEDDPQDPCVSSDDIFHKGLYYRPLTSGLGPDVYQFLRDMGMKFFTNSKIRQPTVCTRETVRPPSYFLNAGFTASTHHVKLSAEVAREERGKRHILETIREFFPETWIWDIILINSTGKASVSYTIPDTITEWKASAFCVEELAGFGMSVPATLTAFQPFFVDLTLPYSIIHGEDFLVRANVFNYLNHCIKINVLLLESLDYQAKLISPEDDGCVCAKIRKSYVWNIFPKGTGDVLFSITAETNDDEACEEEALRNIRIDYRDTQIRALLVEPEGIRREETQNFLICMKDDVISQDVAIDLPTNVVEGSPRPSFSVVGDIMGTAIQNVHQLLQMPFGNGEQNMVLFAPNIYVLDYLDKTRQLSEDVKSKTIGYLVSGYQKQLSYKHPDGSYSTFGIRDKEGNTWLTAFVYKSFAEASRFIYIDDNVQAQTLIWLATKQKTDGCFQSTGILVNNAMKGGVENELSLSAYITIALLEAGHSMSHTVIRNAFYCLETASEKNITDIYTQALVAYAFCLAGKAEICESFLRELQKSAKEVDGSKYWEQNQRSAPEKSHLLDHVQSTDVEITSYVLLALLYKPNRSQEDLTKASAIVQWIIRQQNSYGGFASMQDTVVALQALAAYGAATYNSVTQNVIKINSKNTFEKVFTVNNENRLLLQQTPLPQVPGKYSLTVNGTGCVLIQTALRYNIHLPEGAFGFSLSVQTSNASCPRDQPGKFDIVLISSYTGKRSSSNMVIIDVKMLSGFVPVKSSLDQLIDDHTVMQVEYKKNHVLLYLGNILQKRRKEVTFSVEQDFVVTHPKPAPVQIYDYYETEEYAVAEYMSLCRGVVEEMG

SEQ ID NO: 113 - protein, 1450 aa, Homo sapiens
SVSGKPQYMVLVPSLLHTETTEKGCVLLSYLNETVTVSALESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENELANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEZNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYIKIALLEIPLTVTHPVVRNALFCLESAWKTAEEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDKVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 114 - protein, 1476 aa, Mus musculus
MWKSRRAQLCLFSVLLAFLHSASLLNGDSKYMVLVPSQLYTETPEKICLHLYQLNETVTVTASLVSQSGRKNLFDELVLDKDLFQCVSFIIPRLSSSDEEDFLYVDIKGPTHEFSKRKAVLVKNKESVVFVQTDKPVYKPGQSVKFRVVSMDKMLRPLNELLPLAYIEDPKKNRIMQWRDIKTENGLKQMSFSLAAEPIQGPYKIVVHKESGEKEEHSFTVMEFVLPRFNVDLKVPNAMSVNDEVLSVTACGKYTYGKPVPGHVKINVCRETETGCREVNSQLDNNGCSTQEVNITELQSKKRNYEVQLFHVNATVTEEGTGLEFSRSGTTKIERITNKLIFLKADSHFRHGIPFFVKVRLVDIKGDPIPNEKVFIKAQELSYTSATTTDQHGLAEFSIDTTCISGSSLHIKVNHKEEDSCSYFYCMEERHASAKHVAYAVYSLSKSYIYLDTETSSILPCNQIHTVQAHFILKGDLGVLKELIFYYLVMAQGSIIQTGNHTHQVEPGEAPVKGKFALEIPVEFSMVPMAKMLIYTILPDGEVIADSVNFEIEKCLRNKVDLRFSTSQSLPASQTRLQVTASPQSLCGLRAVDQSVLLLKPESELSPSWIYNLPGMQQNKFVPSSRLSEDQEDCILYSSWLAEKHTNLVPHGTEKDVYRYVEDMGLTAFTNLMIKLPIICFDYGMVPISAPRVEFDLAFTPEISWSLRTTLSKRPEEPPRKDPSSNDPLTETIRKYFPETWVWDIVTVNSTGLAEVEMTVPDTITEWKAGALCLSNDTGLGLSSVVPLQAFKPFFVEVSLPYSVVRGEAFMLKATVMNYLPTSMQMSVQLEASPDFTAVPVGDDQDSYCLSANGRHTSSWLVTPKSLGNVNFSVSAEAQQSSEPCGSEVATVPATGRKDTVVKVLIVEPEGIKQEHTFSSLFCASDAEISEKMSSGPPPTVVKDSARAHFSVMGDILSSAIRNTQNPLHMPYGCGEQNMVLFAPNIYVLKYLNETQQLTQKIKTKALGFLRAGYQRELNYKHKDGSYSAFGDQNGEREGNTWLTAFVLKSFAQARAFIFIDESHITHAFTWLSQKQKDNGCFRSSGSLFNNAMKGGVDDEMTLSAYITMALLESSLPATHPVVSKALSCLESSWKTIEQERNASFVYTKALMAYAFALAGNQNKRDEILKSLDEEAIKENNSIHWKRPQKSRKSEHHLYKPQASSAEVEMNAYVVLARLTAQPAPSPEDLTLSMSTIMWLTKQQNSNGGFSSTQDTVVALDALSKYGAVTFSRSQKTTLVTIQSTGSFSQKFQVENSNRLLLQQVALPDIPGDYTISVSGEGCVYAQTMLRYNMHLEKQLSAFAIWVQTVPLTCNNPKGHNSFQISLEISYTGSRPASNMVIADVKMLSGFIPLKPTVKKLERLEHVSRTEVSNNNVLIYLDQVTNQTLAFSFIIQQDIPVRNLQPAIVKVYDYYETDEMAFAEYSSPCSTDKQNV

SEQ ID NO: 115 - protein, 751 aa, Artificial Sequence
  Description of Artificial Sequence: Alpha 2 macroglobulin Consensus Sequence
IDEDDITIRSYFPESWLWEVEEVDRSPVLTVNITLPDSITTWEILAVSLSNTKGLCVADPVELTVFQDFFLELRLPYSVVRGEQVELRAVLYNYLPSQDIKVVVQLEVEPLCQAGFCSLATQRTRSSQSVRPKSLSSVSFPVVVVPLASGLSLVEVVASVPEFFVKDAVVKTLKVEPEGARKEETVSSLLLPPEHLGGGLEVSEVPALKLPDDVPDTEAEAVISVQGDPVAQAIQNTLSGEGLNNLLRLPSGCGEQNMIYMAPTVYVLHYLDETWQWEKPGTKKKQKAIDLINKGYQRQLNYRKADGSYAAFLHRASSTWLTAFVLKVFSQARNYVFIDEEHICGAVKWLILNQQKDDGVFRESGPVIHNEMKGGVGDDAEVEVTLTAFITIALLEAKLVCISPVVANALSILKASDYLLENYANGQRVYTLALTAYALALAGVLHKLKEILKSLKEELYKALVKGHWERPQKPKDAPGHPYSPQPQAAAVEMTSYALLALLTLLPFPKVEMAPKVVKWLTEQQYYGGGFGSTQDTVMALQALSKYGIATPTHKEKNLSVTIQSPSGSFKSHFQILNNNAFLLRPVELPLNEGFTVTAKVTGQGTLTLVTTYRYKVLDKKNTFCFDLKIETVPDTCVEPKGAKNSDYLSICTRYAGSRSDSGMAIADISMLTGFIPLKPDLKKLENGVDRYVSKYEIDGNHVLLYLDKVSHSETECVGFKIHQDFEVGLLQPASVKVYDYYEPDEQCTAFY

SEQ ID NO: 116 - protein, 620 aa, Artificial Sequence
  Description of Artificial Sequence: Alpha 2 macroglobulin Consensus Sequence
RLLWLLLLLLLFFDSSLQKPRYMVIVPSILRTETPEKVCVQLHDLNETVTVTVSLHSFPGKRNLSSLFTVLLSSKDLFHCVSFTVPQPGLFKSSKGEESFVVVQVKGPTHTFKEKVTVLVSSRRGLVFIQTDKPIYTPGQTVRYRVFSVDENLRPLNELILVYIEDPEGNRVDQWEVNKLEGGIFQLSFPIPSEPIQGTWKIVARYESGPESNYTHYFEVKEYVLPSFEVSITPPKPFIYYDNFKEFEVTICARYTYGKPVPGVAYVRFGVKDEDGKKELLAGLEERAKLLDGNGEICLSQEVLLKELQLKNEDLEGKSLYVAVAVIESEGGDMEEAELGGIKIVRSPYKLKFVKTPSHFKPGIPFFLKVLVVDPDGSPAPNVPVKVSAQDASYYSNGTTDEDGLAQFSINTSGISSLSITVRTNHKELPEEVQAHAEAQATAYSTVSLSKSYIHLSIERTLPCGPGVGEQANFILRGKSLGELKILHFYYLIMSKGKIVKTGREPREPGQGLFSLSIPVTPDLAPSFRLVAYYILPQGEVVADSVWIDVEDCCANKLDLSFSPSKDYRLPAQQVKLRVEADPQSLVALRAVDQAVYLLKPKAKLSMSKVYDLLEKSDLG

SEQ ID NO: 117 - protein, 931 aa, Caenorhabditis elegans
MRKGLRATAARCGLGLGYLLQMLVLPALALLSASGTGSAAQDDEFFHELPETFPSDPPEPLPHFLIEPEEAYIVKNKPVNLYCKASPATQIYFKCNSEWVHQKDHVVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPAEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTSWSKWSTCGTECTHWRRRECTAPAPKNGGKDCDGLVLQSKNCTDGLCMQAAPDSDDVALYVGIVIAVTVCLAITVVVALFVYRKNHRDFESDIIDSSALNGGFQPVNIKAARQDLLAVPPDLTSAAAMYRGPVYALHDVSDKIPMTNSPILDPLPNLKIKVYNSSGAVTPQDDLAEFSSKLSPQMTQSLLENEALNLKNQSLARQTDPSCTAFGTFNSLGGHLIIPNSGVSLLIPAGAIPQGRVYEMYVTVHRKENMRPPMEDSQTLLTPVVSCGPPGALLTRPVILTLHHCADPSTEDWKIQLKNQAVQGQWEDVVVVGEENFTTPCYIQLDAEACHILTENLSTYALVGQSTTKAAAKRLKLAIFGPLCCSSLEYSIRVYCLDDTQDALKEVLQLERQMGGQLLEEPKALHFKGSIHNLRLSIHDIAHSLWKSKLLAKYQEIPFYHIWSGSQRNLHCTFTLERLSLNTVELVCKLCVRQVEGEGQIFQLNCTVSEEPTGIDLPLLDPASTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 118 - protein, 931 aa, Homo sapiens [sequence omitted]

SEQ ID NO: 119 - protein, 931 aa, Caenorhabditis elegans
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIKLDAEACHILTENLSTYALVGHSTTKAAAKRLKLAIFGPLCCSSLEYSIRVYCLDDTQDALKEILHLERQTGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 120 - protein, 931 aa, Caenorhabditis elegans [sequence omitted]

SEQ ID NO: 121 - protein, 945 aa, Rattus norvegicus
MRARSGARGALLLALLLCWDPTPSLAGIDSGGQALPDSFPSAPAEQLPHFLLEPEDAYIVKNKPVELHCRAFPATQIYFKCNGEWVSQKGHVTQESLDEATGLRIREVQIEVSRQQVEELFGLEDYWCQCVAWSSSGTTKSRRAYIRIAYLRKNFDQEPLAKEVPLDHEVLLQCRPPEGVPVAEVEWLKNEDVIDPAQDTNFLLTIDHNLIIRQARLSDTANYTCVAKNIVAKRRSTTATVIVYVNGGWSSWAEWSPCSNRCGRGWQKRTRTCTNPAPLNGGAFCEGQACQKTACTTVCPVDGAWTEWSKWSACSTECAHWRSRECMAPPPQNGGRDCSGTLLDSKNCTDGLCVLNQRTLNDPKSRPLEPSGDVALYAGLVVAVFVVLAVLMAVGVIVYRRNCRDFDTDITDSSAALTGGFHPVNFKTARPSNPQLLHPSAPPDLTASAGIYRGPVYALQDSADKIPMTNSPLLDPLPSLKIKVYDSSTIGSGAGLADGADLLGVLPPGTYPGDFSRDTHFLHLRSASLGSQHLLGLPRDPSSSVSGTFGCLGGRLTIPGTGVSLLVPNGAIPQGKFYDLYLRINKTESTLPLSEGSQTVLSPSVTCGPTGLLLCRPVVLTVPHCAEVIAGDWIFQLKTQAHQGHWEEVVTLDEETLNTPCYCQLEAKSCHILLDQLGTYVFTGESYSRSAVKRLQLAIFAPALCTSLEYSLRVYCLEDTPAALKEVLELERTLGGYLVEEPKTLLFKDSYHNLRLSLHDIPHAHWRSKLLAKYQEIPFYHVWNGSQKALHCTFTLERHSLASTEFTCKVCVRQVEGEGQIFQLHTTLAETPAGSLDALCSAPGNAATTQLGPYAFKIPLSIRQKICNSLDAPNSRGNDWRLLAQKLSMDRYLNYFATKASPTGVILDLWEARQQDDGDLNSLASALEEMGKSEMLVAMTTDGDC

SEQ ID NO: 122 - protein, 104 aa, Artificial Sequence
  Description of Artificial Sequence: U5 Consensus Sequence
PSFLVSGTFDARGGRLRGPRTGVRLIIPPGAIPQGTRYTCYLVVHDKLSTPPPLEEGETLLSPVVECGPHGALFLRPVILEVPHCASLRPRDWEIVLLRSENGG

SEQ ID NO: 123 - protein, 104 aa, Artificial Sequence
  Description of Artificial Sequence: U5 Consensus Sequence
SGFLVSGTFDARGGRLRGPRTGVRLIIPPGAIPQGTRYTCYLVVHDKLSTPPPLEEGETLLSPVVECGPHGALFLRPVILEVPHCASLRPRDWELVLLRSENGG

SEQ ID NO: 124 - protein, 96 aa, Artificial Sequence
  Description of Artificial Sequence: DEATH domain Consensus Sequence
PPGAASLTELTREKLAKLLDHDLGDDWRELARKLGLSEADIDQIETESPRDLAEQSYQLLRLWEQREGKNATLGTLLEALRKMGRDDAVELLRSEL

SEQ ID NO: 125 - protein, 51 aa, Artificial Sequence
  Description of Artificial Sequence: Thrombospondin Type 1 Consensus Sequence
WGEWSEWSPCSVTCGGGVQTRTRCCNPPPNGGGPCTGPDTETRACNEQPCP

SEQ ID NO: 126 - protein, 83 aa, Artificial Sequence
  Description of Artificial Sequence: Death Domain Consensus Sequence
RELCKLLDDPLGRDWRRLARKLGLSEEEIDQIEHENPRLASPTYQLLDLWEQRGGKNATVGTLLEALRKMGRDDAVELLESAL

SEQ ID NO: 127 - protein, 48 aa, Artificial Sequence
  Description of Artificial Sequence: Thrombospondin Type 1 Consensus Sequence
SPWSEWSPCSVTCGKGIRTRQRTCNSPAGGKPCTGDAQETEACMMDPC

SEQ ID NO: 128 - protein, 63 aa, Artificial Sequence
  Description of Artificial Sequence: Immunoglobulin C-2 Consensus Sequence
LEGESVTLTCPASGDPVPNITWLKDGKPLPESRVVASGSTLTIKNVSLEDSGLYTCVARNSVG

SEQ ID NO: 129 - protein, 56 aa, Rattus norvegicus
LFAQLAQLLPATMSDKPDMAEIEKFDKSKLKKTETQEKNPLPSKETIEQEKQAGES

SEQ ID NO: 130 - protein, 343 aa, Homo sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 131 - protein, 389 aa, Xenopus laevis
MLQYLSFVLIFIHHQACGVPVISNRIVGGMDSKRGEWPWQISLSYKSDSICGGSLLTDSWVMTAAHCIDSLDVSYYTVYLGAYQLSAPDNSTVSRGVKSITKHPDFQYEGSSGDIALIELEKPVTFTPYILPICLPSQDVQFAAGTMCWVTGWGNIQEGTPLISPKTIQKAEVAIIDSSVCGTMYESSLGYIPDFSFIQEDMVCAGYKEGRIDACQGDSGGPLVCNVNNVWLQLGIVSWGYGCAEPNRPGVYTKVQYYQDWLKTNVPLIVFSEEGPSVAPSIGPSIAPSFGPSLGPRGVASTTISQTEAQSVNSIEIDKTNSTTIFETEAMSMSNNTTMNETFSLVSSTISTALRINETKTIDNEAQIHACSLHTIALTLIYLFIRFFV

SEQ ID NO: 132 - protein, 855 aa, Homo sapiens [sequence omitted]

SEQ ID NO: 133 - protein, 342 aa, Rattus norvegicus
MALRVGLGLGQLEALFVLLLIGLLQSRIGADGTEASCGAVIQPRITGGGSAKPGQWPWQVSITYNGVHVCGGSLVSNQWVVSAAHCFPREHSKEEYEVKLGAHQLDSFSNDIVVHTVAQIISHSSYREEGSQGDIALIRLSSPVTFSRYIRPICLPAANASFPNGLHCTVTGWGHVAPSVSLQTPRPLQQLEVPLISRETCSCLYNINAVPEEPHTIQQDMLCAGYVKGGKDACQGDSGGPLSCPIDGLWYLAGIVSWGDACGAPNRPGVYTLTSTYASWIHHHVAELQPRVVPQTQESQPDGHLCNHHPVFNLAAAQKLSRPILFLPLSLTLGLFSLWLEH

SEQ ID NO: 134 - protein, 342 aa, Rattus norvegicus
MALRVGLGLGQLEALFILLLIGLLQSRIGADGTEASCGAVIQPRITGGGSAKPGQWPWQVSITYNGVHVCGGSLVSNQWVVSAAHCFPREHSKEEYEVKLGAHQLDSFSNDIVVHTVAQIISHSSYREEGSQGDIALIRLSSPVTFSRYIRPICLPAANASFPNGLHCTVTGWGHVAPSVSLQTPRPLQQLEVPLISRETCSCLYNINAVPEEPHTIQQDMLCAGYVKGGKDACQGDSGGPLSCPIDGLWYLAGIVSWGDACGAPNRPGVYTLTSTYASWIHHHVAELQPRAVPQTQESQPDGHLCNHHPVFNLAAAQKLSRPILFLPLSLTLGLFSLWLEH

SEQ ID NO: 135 - protein, 230 aa, Artificial Sequence
  Description of Artificial Sequence: Trypsin-like serine protease Consensus Sequence
RIVGGSEANIGSFPWQVSLQYRGGRHFCGGSLISPRWVLTAAHCVYGSAPSSIRVRLGSHDLSSGEETQTVKVSKVIVHPNYNPSTYDNDIALLKLSEPVTLSDTVRPICLPSSGYNVPAGTTCTVSGWGRTSESSGSLPDTLQEVNVPIVSNATCRRAYSGGPAITDNMLCAGGLEGGKDACQGDSGGPLVCNDPRWVLVGIVSWGSYGCARPNKPGVYTRVSSYLDWI

SEQ ID NO: 136 - protein, 217 aa, Artificial Sequence
  Description of Artificial Sequence: Trypsin Consensus Sequence
IVGGREAQAGSFPWQVSLQVSSGHFCGGSLISENWVLTAAHCVSGASSVRVVLGEHNLGTTEGTEQKFDVKKIIVHPNYNPDTNDIALLKLKSPVTLGDTVRPICLPSASSDLPVGTTCSVSGWGRTKNLGTSDTLQEVVVPIVSRETCRSAYGGTVTDTMICAGALGGKDACQGDSGGPLVCSDGELVGIVSWGYGCAVGNYPGVYTRVSRYLDWI

SEQ ID NO: 137 - DNA, 30 bp, Artificial Sequence
  Description of Artificial Sequence: NOV2a and b Primer 1
tcaaatgttcagttttgattgttgttcttg

SEQ ID NO: 138 - DNA, 25 bp, Artificial Sequence
  Description of Artificial Sequence: NOV2a and b Primer 2
tttttgctaaaagcagcaatgccat

SEQ ID NO: 139 - DNA, 27 bp, Artificial Sequence
  Description of Artificial Sequence: NOV2c Primer 1
attgacttatgcttcctagttcgttgc

SEQ ID NO: 140 - DNA, 28 bp, Artificial Sequence
  Description of Artificial Sequence: NOV2c Primer 2
caacatttaaaagaatggacgattttca

SEQ ID NO: 141 - DNA, 25 bp, Artificial Sequence
  Description of Artificial Sequence: NOV2d Primer 1
ctgtattccggatcgatgcaagaag

SEQ ID NO: 142 - DNA, 27 bp, Artificial Sequence
  Description of Artificial Sequence: NOV2d Primer 2
tcttaaggagaagaaaatctgccgaag

SEQ ID NO: 143 - DNA, 27 bp, Artificial Sequence
  Description of Artificial Sequence: NOV3a Primer 1
tggaaactctaaaaagcagagcgcctc

SEQ ID NO: 144 - DNA, 27 bp, Artificial Sequence
  Description of Artificial Sequence: NOV3a Primer 2
cctctaggtgagtcagtgcgtcactct

SEQ ID NO: 145 - DNA, 17 bp, Artificial Sequence
  Description of Artificial Sequence: NOV6 Primer 1
atggggggcctgacagc

SEQ ID NO: 146 - DNA, 25 bp, Artificial Sequence
  Description of Artificial Sequence: NOV6 Primer 2
ttatgtggcacagtccatagtctgc

SEQ ID NO: 147 - DNA, 30 bp, Artificial Sequence
  Description of Artificial Sequence: NOV8 Primer 1
atgatatgtcttccacattactgacattca

SEQ ID NO: 148 - DNA, 26 bp, Artificial Sequence
  Description of Artificial Sequence: NOV8 Primer 2
ttagagccacaaactaaccagctcat

SEQ ID NO: 149 - DNA, 20 bp, Artificial Sequence
  Description of Artificial Sequence: Ag3802 Forward Primer
gtcgatgggacatctttcct

SEQ ID NO: 150 - DNA, 26 bp, Artificial Sequence
  Description of Artificial Sequence: Ag3802 Probe Primer
cttcggatcactatcatccagtgcca

SEQ ID NO: 151 - DNA, 20 bp, Artificial Sequence
  Description of Artificial Sequence: Ag3802 Reverse Primer
atgaggaagtagcccacgtt

SEQ ID NO: 152 - DNA, 22 bp, Artificial Sequence
  Description of Artificial Sequence: Ag4849 Forward Primer
gccagttctacctcaagttcct

SEQ ID NO: 153 - DNA, 24 bp, Artificial Sequence
  Description of Artificial Sequence: Ag4849 Probe Primer
ctaccaccatgtgtcccgccgttt

SEQ ID NO: 154 - DNA, 22 bp, Artificial Sequence
  Description of Artificial Sequence: Ag4849 Reverse Primer
catagtcagagtcgagcaggaa

SEQ ID NO: 155 - DNA, 19 bp, Artificial Sequence
  Description of Artificial Sequence: Ag400 Forward Primer
acgatcctgggctggacag

SEQ ID NO: 156 - DNA, 21 bp, Artificial Sequence
  Description of Artificial Sequence: Ag400 Probe Primer
catctgcgcgtagcccctcca

SEQ ID NO: 157 - DNA, 20 bp, Artificial Sequence
  Description of Artificial Sequence: Ag400 Reverse Primer
gcttcaaccccctcgagttc

SEQ ID NO: 158 - DNA, 22 bp, Artificial Sequence
  Description of Artificial Sequence: Ag2866 Forward Primer
tatgtactcgtggtccctgaga

SEQ ID NO: 159 - DNA, 26 bp, Artificial Sequence
  Description of Artificial Sequence: Ag2866 Probe Primer
acgtctacagctttggctacctccgg

SEQ ID NO: 160 - DNA, 22 bp, Artificial Sequence
  Description of Artificial Sequence: Ag2866 Reverse Primer
agtggctgatgaagtcatagga

SEQ ID NO: 161 - DNA, 19 bp, Artificial Sequence
  Description of Artificial Sequence: Ag3077 Forward Primer
aatgtggagctgtgcctgt

SEQ ID NO: 162 - DNA, 23 bp, Artificial Sequence
  Description of Artificial Sequence: Ag3077 Probe Primer
gactcatgccaggaatgtgcccc

SEQ ID NO: 163 - DNA, 20 bp, Artificial Sequence
  Description of Artificial Sequence: Ag3077 Reverse Primer
gaagagacctttgacgtccc

SEQ ID NO: 164 - DNA, 22 bp, Artificial Sequence
  Description of Artificial Sequence: Ag2908 Forward Primer
attgtttacatcaaacggcatt

SEQ ID NO: 165 - DNA, 26 bp, Artificial Sequence
  Description of Artificial Sequence: Ag2908 Probe Primer
aatccttttgaggcccttgtcccata

SEQ ID NO: 166 - DNA, 22 bp, Artificial Sequence
  Description of Artificial Sequence: Ag2908 Reverse Primer
tcccagttgagactcctactga

SEQ ID NO: 167 - DNA, 22 bp, Artificial Sequence
  Description of Artificial Sequence: Ag1522 Forward Primer
tgacttcgacacagacatcact

SEQ ID NO: 168 - DNA, 24 bp, Artificial Sequence
  Description of Artificial Sequence: Ag1522 Probe Primer
actcatctgctgccctgactggtg

SEQ ID NO: 169 - DNA, 21 bp, Artificial Sequence
  Description of Artificial Sequence: Ag1522 Reverse Primer
ccttgccgtcttaaagttgac

SEQ ID NO: 170 - DNA, 22 bp, Artificial Sequence
  Description of Artificial Sequence: Ag1848 Forward Primer
tgacttcgacacagacatcact

SEQ ID NO: 171 - DNA, 24 bp, Artificial Sequence
  Description of Artificial Sequence: Ag1848 Probe Primer
actcatctgctgccctgactggtg

SEQ ID NO: 172 - DNA, 21 bp, Artificial Sequence
  Description of Artificial Sequence: Ag1848 Reverse Primer
ccttgccgtcttaaagttgac

SEQ ID NO: 173 - DNA, 22 bp, Artificial Sequence
  Description of Artificial Sequence: Ag2263 Forward Primer
tgacttcgacacagacatcact

SEQ ID NO: 174 - DNA, 24 bp, Artificial Sequence
  Description of Artificial Sequence: Ag2263 Probe Primer
actcatctgctgccctgactggtg

SEQ ID NO: 175 - DNA, 21 bp, Artificial Sequence
  Description of Artificial Sequence: Ag2263 Reverse Primer
ccttgccgtcttaaagttgac

SEQ ID NO: 176 - DNA, 19 bp, Artificial Sequence
  Description of Artificial Sequence: Ag2422 Forward Primer
ggctccctggacactctct

SEQ ID NO: 177 - DNA, 26 bp, Artificial Sequence
  Description of Artificial Sequence: Ag2422 Probe Primer
ctgtcaccacccagctgggaccttat

SEQ ID NO: 178 - DNA, 20 bp, Artificial Sequence
  Description of Artificial Sequence: Ag2422 Reverse Primer
tggacagtgggatcttgaag

SEQ ID NO: 179 - DNA, 20 bp, Artificial Sequence
  Description of Artificial Sequence: Ag2421 Forward Primer
tgaggctgagctctctgtgt

SEQ ID NO: 180 - DNA, 26 bp, Artificial Sequence
  Description of Artificial Sequence: Ag2421 Probe Primer
tctgctaactgtgaaggatctcacca

SEQ ID NO: 181 - DNA, 20 bp, Artificial Sequence
  Description of Artificial Sequence: Ag2421 Reverse Primer
ctggtccacattgtcaggaa

SEQ ID NO: 182 - DNA, 22 bp, Artificial Sequence
  Description of Artificial Sequence: Ag2873 Forward Primer
ccctgctcacaagactgactag

SEQ ID NO: 183 - DNA, 24 bp, Artificial Sequence
  Description of Artificial Sequence: Ag2873  Probe Primer
ctccacgcagtttcaggcatgaag

SEQ ID NO: 184 - DNA, 22 bp, Artificial Sequence
  Description of Artificial Sequence: Ag2873 Reverse Primer
gacattaggagacaacctccaa

SEQ ID NO: 185 - DNA, 22 bp, Artificial Sequence
  Description of Artificial Sequence: Ag2878 Forward Primer
catctctaagaatgccctcaga

SEQ ID NO: 186 - DNA, 26 bp, Artificial Sequence
  Description of Artificial Sequence: Ag2878 Probe Primer
cttcgctcgcttacacacctaagcct

SEQ ID NO: 187 - DNA, 22 bp, Artificial Sequence
  Description of Artificial Sequence: Ag2878 Reverse Primer
gagggtctccagatggttattg

SEQ ID NO: 188 - DNA, 20 bp, Artificial Sequence
  Description of Artificial Sequence: Ag1799 Forward Primer
gaccaacggctttcttcaag

SEQ ID NO: 189 - DNA, 26 bp, Artificial Sequence
  Description of Artificial Sequence: Ag1799 Probe Primer
accttccttcttgcgacttggatcct

SEQ ID NO: 190 - DNA, 22 bp, Artificial Sequence
  Description of Artificial Sequence: Ag1799 Reverse Primer
tcagttgttcaaagcacacaaa

SEQ ID NO: 191 - DNA, 20 bp, Artificial Sequence
  Description of Artificial Sequence: Ag2911 Forward Primer
cagggatggaatgcattatg

SEQ ID NO: 192 - DNA, 27 bp, Artificial Sequence
  Description of Artificial Sequence: Ag2911 Probe Pirmer
caatgtcacctgtactcagatctgtga

SEQ ID NO: 193 - DNA, 21 bp, Artificial Sequence
  Description of Artificial Sequence: Ag2911 Reverse Primer
gctctccaaagcagtaaggaa

SEQ ID NO: 194 - DNA, 20 bp, Artificial Sequence
  Description of Artificial Sequence: Ag1559 Forward Primer
caggacctcggttatcaaca

SEQ ID NO: 195 - DNA, 23 bp, Artificial Sequence
  Description of Artificial Sequence: Ag1559 Probe Primer
acctacgttgagcaaccgtgccg

SEQ ID NO: 196 - DNA, 19 bp, Artificial Sequence
  Description of Artificial Sequence: Ag1559 Reverse Primer
atcgtactcgctggcgtaa

SEQ ID NO: 197 - DNA, 1062 bp, Homo sapiens
ggatcctcccagttggaggaggtgtttcactctgaaaaagagacgaagagctcaagaataaaggctgaagaaaaagaggtggtaagaataaaggctgaaggaaaagagattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacagttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccactggcataggctttactgtcacatccgccccaggtcatgaaaatgttcactgcaatcatcccttcctgttcttcatcaggcacaatgaatccaacagcatcctcttcttcggcagattttcttctcctctcgag

SEQ ID NO: 198 - protein, 354 aa, Homo sapiens
GSSQLEEVFHSEKETKSSRIKAEEKEVVRIKAEGKEIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDSYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSPLE

SEQ ID NO: 199 - DNA, 33 bp, Artificial Sequence
  Description of Artificial Sequence: NOV2e Primer F1
ggatcctcccagttggaggaggtgtttcactct

SEQ ID NO: 200 - DNA, 38 bp, Artificial Sequence
  Description of Artificial Sequence: NOV2e Primer R1
ctcgagaggagaagaaaatctgccgaagaagaggatgc

SEQ ID NO: 201 - DNA, 25 bp, Artificial Sequence
  Description of Artificial Sequence: NOV2e Primer SF1
atgaactgaacataaccaacaggct

SEQ ID NO: 202 - DNA, 23 bp, Artificial Sequence
  Description of Artificial Sequence: NOV2e Primer SF2
ggacttgttcccagatggctcta

SEQ ID NO: 203 - DNA, 25 bp, Artificial Sequence
  Description of Artificial Sequence: NOV2e Primer SF3
tttagcttcactttcctggaggact

SEQ ID NO: 204 - DNA, 26 bp, Artificial Sequence
  Description of Artificial Sequence: NOV2e Primer SF4
aaagaaaggtgaatctgcacttgccc

SEQ ID NO: 205 - DNA, 23 bp, Artificial Sequence
  Description of Artificial Sequence: NOV2e Primer SF5
ttgtggcagtaactgaggaaggc

SEQ ID NO: 206 - DNA, 25 bp, Artificial Sequence
  Description of Artificial Sequence: NOV2e Primer SR1
agcctgttggttatgttcagttcat

SEQ ID NO: 207 - DNA, 25 bp, Artificial Sequence
  Description of Artificial Sequence: NOV2e Primer SR2
tttttcatttgttttgctttcaacc

SEQ ID NO: 208 - DNA, 25 bp, Artificial Sequence
  Description of Artificial Sequence: NOV1b Primer SF5
gggatcctccagatcctgtattttt

SEQ ID NO: 209 - DNA, 25 bp, Artificial Sequence
  Description of Artificial Sequence: NOV2e Primer SR3
aggaatggctctgtgtcatcatctg

SEQ ID NO: 210 - DNA, 24 bp, Artificial Sequence
  Description of Artificial Sequence: NOV2e Primer SR4
ctttcttccatatgccctggacta

SEQ ID NO: 211 - DNA, 24 bp, Artificial Sequence
  Description of Artificial Sequence: NOV2e Primer SR5
caaaggaactgtgcaggaacttct

SEQ ID NO: 212 - DNA, 26 bp, Artificial Sequence
  Description of Artificial Sequence: NOV1b Primer SR3
gtgaatgcaaacttgaggtcttttgt

SEQ ID NO: 213 - DNA, 29 bp, Artificial Sequence
  Description of Artificial Sequence: NOV1b Primer SR4
cctcatataatcctaccattggctgtact

SEQ ID NO: 214 - DNA, 27 bp, Artificial Sequence
  Description of Artificial Sequence: NOV1b Primer SR5
gaggatcccagtgtaaaaatacttctg

SEQ ID NO: 215 - DNA, 27 bp, Artificial Sequence
  Description of Artificial Sequence: NOV1b Primer SR6
tagcacttcataagcaataatgatccc

SEQ ID NO: 216 - DNA, 28 bp, Artificial Sequence
  Description of Artificial Sequence: NOV1b Primer SR7
tgagtgtactagcagacacctcaatgat

SEQ ID NO: 217 - DNA, 18 bp, Artificial Sequence
  Description of Artificial Sequence: NOV11c Primer SF1
gccctcccggtccaggtc

SEQ ID NO: 218 - DNA, 19 bp, Artificial Sequence
  Description of Artificial Sequence: NOV11c Primer SF2
ggcgacggcaccagcatgt

SEQ ID NO: 219 - DNA, 19 bp, Artificial Sequence
  Description of Artificial Sequence: NOV11c Primer SR1
gcctggcctgccgggttct

SEQ ID NO: 220 - DNA, 19 bp, Artificial Sequence
  Description of Artificial Sequence: NOV11c Primer SR2
catgagcacgtggtaagcg

SEQ ID NO: 221 - DNA, 24 bp, Artificial Sequence
  Description of Artificial Sequence: NOV1b Primer SF1
gtgctggcattggagtgtttagtg

SEQ ID NO: 222 - DNA, 25 bp, Artificial Sequence
  Description of Artificial Sequence: NOV1b Primer SF2
atcaagcacgttgacacagaatgag

SEQ ID NO: 223 - DNA, 27 bp, Artificial Sequence
  Description of Artificial Sequence: NOV1b Primer SF3
gcattcactaacctaacaccatttaca

SEQ ID NO: 224 - DNA, 27 bp, Artificial Sequence
  Description of Artificial Sequence: NOV1b Primer SF4
gttcagcagagatgtcgtctgaccttc

SEQ ID NO: 225 - DNA, 27 bp, Artificial Sequence
  Description of Artificial Sequence: NOV1b Primer SF6
tgaagaacacatcaacaacagacataa

SEQ ID NO: 226 - DNA, 27 bp, Artificial Sequence
  Description of Artificial Sequence: NOV1b Primer SR1
actgttttcagcagctaccttaatttc

SEQ ID NO: 227 - DNA, 24 bp, Artificial Sequence
  Description of Artificial Sequence: NOV1b Primer SR2
cttgatgaatgtgtggtacgcgat

What is claimed is:

1. An isolated nucleic acid molecule comprising the nucleic acid sequence of SEQ ID NO:45.

2. An isolated nucleic acid molecule consisting of the nucleic acid sequence of SEQ ID NO:45.

3. An isolated nucleic acid molecule encoding a polypeptide comprising the amino acid sequence of SEQ ID NO:46.

4. An isolated nucleic acid molecule encoding a polypeptide consisting of the amino acid sequence of SEQ ID NO:46.

5. An isolated nucleic acid molecule encoding a polypeptide comprising a mature form of the amino acid sequence of SEQ ID NO:46.

6. An isolated nucleic acid molecule encoding a polypeptide consisting of a mature form of the amino acid sequence of SEQ ID NO:46.

* * * * *